US007927818B2

(12) United States Patent
Felgner et al.

(10) Patent No.: US 7,927,818 B2
(45) Date of Patent: Apr. 19, 2011

(54) **COMPOSITIONS AND METHODS FOR IMMUNODOMINANT ANTIGENS OF *MYCOBACTERIUM TUBERCULOSIS***

(76) Inventors: Philip Felgner, Rancho Sante Fe, CA (US); Xiaowu Liang, La Jolla, CA (US); Maria Laura Gennaro, New York, NY (US)

( * ) Notice: Subject to any disclaimer, the term of this patent is extended or adjusted under 35 U.S.C. 154(b) by 0 days.

(21) Appl. No.: 12/465,136

(22) Filed: May 13, 2009

(65) Prior Publication Data

US 2009/0285847 A1 Nov. 19, 2009

Related U.S. Application Data

(63) Continuation-in-part of application No. 12/447,620, filed as application No. PCT/US2007/023299 on Nov. 1, 2007.

(60) Provisional application No. 60/856,217, filed on Nov. 1, 2006.

(51) Int. Cl.
*G01N 33/53* (2006.01)

(52) U.S. Cl. ........ 435/7.1; 435/7.32; 435/7.9; 435/7.92; 424/248.1

(58) Field of Classification Search ........................ None
See application file for complete search history.

(56) References Cited

U.S. PATENT DOCUMENTS

| | | | |
|---|---|---|---|
| 6,294,328 | B1 | 9/2001 | Fleischmann et al. |
| 2002/0164588 | A1 | 11/2002 | Eisenberg et al. |
| 2004/0029129 | A1 | 2/2004 | Wang et al. |
| 2005/0084904 | A1 | 4/2005 | Laal et al. |
| 2005/0244857 | A1 | 11/2005 | Ni et al. |
| 2005/0260225 | A1 | 11/2005 | Goldberg et al. |
| 2006/0002949 | A1 | 1/2006 | Glenn et al. |
| 2006/0034871 | A1 | 2/2006 | Grandi et al. |
| 2008/0171345 | A1 | 7/2008 | Belisle et al. |

FOREIGN PATENT DOCUMENTS

| | | |
|---|---|---|
| WO | WO 9816645 A2 * | 4/1998 |
| WO | WO 9844119 A1 * | 10/1998 |
| WO | WO 9924577 A1 * | 5/1999 |
| WO | WO 9942076 A2 * | 8/1999 |
| WO | WO 9942118 A2 * | 8/1999 |
| WO | 2006088492 | 8/2006 |
| WO | 2008/140478 | 11/2008 |
| WO | 2008140478 | 11/2008 |
| WO | 2009/024822 | 2/2009 |

OTHER PUBLICATIONS

Greenspan et al (Nature Biotechnology 7: 936-937, 1999).*
Chothia et al (The EMBO Journal, 1986, 5/4:823-26).*
Davies, D. Huw, et al. "Proteome-wide analysis of the serological response to vaccinia and smallpox." Proteomics Journal, 2007, pp. 1678-1686, 7, Wiley-VCH.
Davies, D. Huw, et al. "Profiling the humoral immune response to infection by using proteome microarrays." PNAS journal, Jan. 18, 2005. pp. 547-552, vol. 102, No. 3. Proceedings of the National Academy of Sciences of the United States of America.
McMurry, J., et al.; "Analyzing *Mycobacterium tuberculosis* proteomes for candidate vaccine epitopes"; Tuberculosis, Elsevier, GB, vol. 85, No. 1-2, Jan. 1, 2005, pp. 95-105.
Kalra, et al.; "Supplementation with RD antigens enhances the protective efficacy of BCG in tuberculous mice"; Clinical Immunology, Academic Press, US; vol. 125, No. 2; Oct. 16, 2007, pp. 173-183.
Lyaschchenko K. P., et al; "A multi-antigen print immunoassay for the development of serological diagnosis of infectious diseases"; Journal of Immunological Methods, Elsevier Science Publishers B. V., Amsterdam, NL; vol. 242, No. 1-2, Aug. 28, 2000; pp. 91-100.
Wang, Jiuling, et al.; "PPE protein (Rv3425) from DNA segment RD11 of Mycobacterium tuberculosos: a novel immunodominant antigen of *Mycobacterium tuberculosis* induces humoral and cellular immune responses in mice"; Microbiology and Immunology; vol. 52; No. 4; Apr. 2008; pp. 224-230.

* cited by examiner

*Primary Examiner* — Jennifer E Graser
(74) *Attorney, Agent, or Firm* — Fish & Associates, PC

(57) ABSTRACT

Contemplated compositions, devices, and methods are drawn to various antigens from the pathogen *M. tuberculosis* and their use in vaccines, therapeutic agents, and various diagnostic tests. In particularly preferred aspects, the antigens are immunodominant and have quantified and known relative reactivities with respect to sera of a population infected with the pathogen, and/or have a known association with a disease parameter.

13 Claims, 8 Drawing Sheets

| | | p.value | Bonferroni | BH | RF | |
|---|---|---|---|---|---|---|
| 1 | Rv3804c | 0 | 0 | 0 | 0.005678 | 2 |
| 2 | Rv3881c | 2.22E-16 | 9.17E-13 | 4.59E-13 | 0.005784 | 1 |
| 3 | Rv3874 | 1.11E-15 | 4.59E-12 | 1.53E-12 | 0.003021 | 3 |
| 4 | Rv1860 | 9.04E-13 | 3.73E-09 | 9.33E-10 | 0.002056 | 5 |
| 5 | Rv0798c | 2.90E-10 | 1.20E-06 | 2.39E-07 | 0.002045 | 6 |
| 6 | Rv0934 | 6.82E-08 | 0.000282 | 4.70E-05 | 0.002145 | 4 |
| 7 | Rv3616c | 8.72E-06 | 0.036043 | 0.005149 | 0.00065 | 9 |
| 8 | Rv1886c | 2.55E-05 | 0.105263 | 0.013158 | 0.000768 | 7 |
| 9 | Rv2252 | 4.35E-05 | 0.179754 | 0.016566 | 0.000117 | 21 |
| 10 | Rv2282c | 4.36E-05 | 0.180194 | 0.016566 | 7.15E-05 | 24 |
| 11 | Rv0212c | 4.41E-05 | 0.182224 | 0.016566 | 8.46E-05 | 22 |
| 12 | Rv3243c | 5.05E-05 | 0.208665 | 0.017389 | 0.000207 | 17 |
| 13 | Rv3675 | 5.65E-05 | 0.233437 | 0.017957 | 0.000688 | 8 |
| 14 | Rv3472 | 8.13E-05 | 0.335899 | 0.02155 | 0.000573 | 11 |
| 15 | Rv2984 | 8.87E-05 | 0.366342 | 0.02155 | 2.82E-05 | 25 |
| 16 | Rv1175c | 8.53E-05 | 0.3524 | 0.02155 | 0.000158 | 18 |
| 17 | Rv3326 | 7.82E-05 | 0.322846 | 0.02155 | 1.96E-05 | 26 |
| 18 | Rv3628 | 0.00012 | 0.494384 | 0.027466 | 0.000591 | 10 |
| 19 | Rv3775 | 0.000127 | 0.526349 | 0.027703 | 1.82E-05 | 27 |
| 20 | Rv3362c | 0.000144 | 0.595767 | 0.028111 | 0.00027 | 14 |
| 21 | Rv0801 | 0.00015 | 0.618447 | 0.028111 | 0.000448 | 13 |
| 22 | Rv1629 | 0.000146 | 0.601442 | 0.028111 | 0.000265 | 15 |
| 23 | Rv0272c | 0.000165 | 0.680498 | 0.029587 | 0.000147 | 19 |
| 24 | Rv2031c | 0.0002 | 0.826197 | 0.034119 | 0.000526 | 12 |
| 25 | Rv3762c | 0.000215 | 0.887103 | 0.034119 | -2.70E-05 | 28 |
| 26 | Rv3319 | 0.000214 | 0.885635 | 0.034119 | 0.000138 | 20 |
| 27 | Rv3495c | 0.00024 | 0.989573 | 0.036651 | 8.03E-05 | 23 |
| 28 | Rv2151c | 0.000276 | 1 | 0.040649 | 0.000253 | 16 |

Figure 2C

| Rv number | RF | CERNO-RF | CERNO |
|---|---|---|---|
| Rv0583c | 12 | 4 | 8 |
| Rv0798c | 5 | 6 | 6 |
| Rv0934 | 19 | N/A | 7 |
| Rv1193 | 9 | N/A | >50 |
| Rv1196 | 7 | N/A | 19 |
| Rv1253 | 6 | N/A | >50 |
| Rv1387 | 10 | N/A | >50 |
| Rv1837c | >50 | 8 | 15 |
| Rv1860 | 4 | 3 | 3 |
| Rv1886c | 33 | N/A | 9 |
| Rv2031c | 8 | N/A | 10 |
| Rv2396 | 35 | 9 | 1 |
| Rv3248c | >50 | 7 | 13 |
| Rv3804c | 2 | 2 | 5 |
| Rv3874 | 3 | 5 | 2 |
| Rv3881c | 1 | 1 | 4 |

FIGURE 4A

| Rv number | RF | CERNO-RF | CERNO |
|---|---|---|---|
| Rv0379 | 10 | 11 | 11 |
| Rv0798c | 5 | 5 | 6 |
| Rv0934 | 22 | 30 | 7 |
| Rv0959 | >50 | 10 | >50 |
| Rv1196 | 8 | 6 | 17 |
| Rv1387 | 7 | N/A | >50 |
| Rv1860 | 4 | 4 | 2 |
| Rv1886c | >50 | >50 | 10 |
| Rv2031c | 6 | 7 | 8 |
| Rv2396 | >50 | N/A | 4 |
| Rv3248c | 12 | 8 | 13 |
| Rv3616c | 9 | 9 | 9 |
| Rv3804c | 2 | 2 | 5 |
| Rv3874 | 3 | 3 | 1 |
| Rv3881c | 1 | 1 | 3 |

FIGURE 4B

COMPOSITIONS AND METHODS FOR IMMUNODOMINANT ANTIGENS OF *MYCOBACTERIUM TUBERCULOSIS*

This application is a continuation-in-part of our copending U.S. application with the Ser. No. 12/447,620, which is a U.S. national phase filing of International application with the serial number PCT/US07/23299, which was filed Nov. 1, 2007, and which claims priority to U.S. provisional application with the Ser. No. 60/856,217, which was filed Nov. 1, 2006, all of which are incorporated by reference herein in their entirety.

FIELD OF THE INVENTION

The field of the invention is compositions and methods related to selected antigens from *Mycobacterium tuberculosis*, especially as they relate to their use in diagnostic and therapeutic compositions and methods.

BACKGROUND

Antigens for vaccination and/or diagnostic purposes are typically single antigens from a pathogen, or complex mixtures of multiple known antigens from a pathogen, or of multiple known and unknown antigens of a pathogen such as live, attenuated or inactivated bacteria or viruses. Depending on the particular type of pathogen, single antigens may provide a quantifiable signal in immunodiagnostic tests (antibody or cellular responses). However, due to variations among individuals in their immune response profiles, single antigen tests are often not sufficient to obtain useful diagnostic information with useful specificity and sensitivity.

For example, multiple tests are often required for accurate diagnosis of tuberculosis (TB). Most typically, a person suspected of being infected with *M. tuberculosis* is tested using the tuberculin skin test (TST) that often provides variable results, which make their interpretation rarely consistent. Alternative tests are the interferon gamma release assays (IGRAs). These tests are more specific that TST but they still do not provide means of distinguishing persons having active tuberculosis from persons who are infected but are not currently harboring an active disease process. For investigation of active TB, a sputum smear test for acid fast bacilli can be employed to identify *M. tuberculosis* directly, which tends to provide good specificity. However, the sensitivity varies widely among different laboratories. To obtain a more definite result, active TB may be diagnosed by bacterial culture from, e.g., sputum or other bodily fluids. Unfortunately, such test requires a dedicated microbiology laboratory and several weeks to obtain the results. More recently developed methods, such as real time PCR assays are relatively accurate but require sophisticated equipment and highly trained personnel, and they are very susceptible to cross-sample contamination.

Based on the above drawbacks it is therefore desirable to develop an antibody-based test that would overcome at least some of the difficulties associated with bacterial culture, genetic analysis or other known methods, and considerable effort has been spent defining and identifying immunoreactive proteins in membrane fractions of *M. tuberculosis* and *M. tuberculosis*-conditioned culture medium ('culture filtrate proteins' or CFPs). Candidate antigens are typically tested for diagnostic utility in ELISAs and Western blots using TB sera and sera from healthy controls. CFPs are more widely studied because of the convenience of working with soluble proteins. Of the >100 *M. tuberculosis* proteins in culture filtrates (representing about 2.5% of the *M. tuberculosis* proteome), roughly two dozen are recognized by sera from TB patients, most of which have been previously identified. Yet despite these efforts, there remains no effective serological test with the sensitivity and specificity required to accurately diagnose TB, particularly in the early stage of infection. Moreover, none of the heretofore known antigens is generally applicable to differentiate among stages (e.g., active disease versus non-active), secondary infections, etc., as the signal is either impossible to deconvolute (e.g., compound signal from inactivated pathogen) or only provides a single data point.

Similarly, where known antigens are used in a vaccine, numerous problems are known due to the variability of individual immune response and potential prior exposure. More recently, multivalent vaccine preparations have become available where in a single dose, multiple and distinct antigens, from multiple and distinct serotypes, of a single pathogenic organisms were combined (Prevnar™: Heptavalent vaccine against *Streptococcus pneumoniae* capsular serotypes 4, 6B, 9V, 14, 18C, 19F, and 23F). While such mixed preparations tend to provide a broader range of protection against different serotypes, various difficulties nevertheless remain. Most significantly, where a single antigen fails to elicit an immune response, coverage to the corresponding serotype is not present. Thus, combination of single defined antigens from several serotypes merely combines benefits and problems associated with the single antigens.

Therefore, while numerous methods of identification and use of antigens are known in the art, all or almost all of them suffer from one or more disadvantages. Consequently, there remains a large, unmet need to provide improved compositions and methods of antigens from *M. tuberculosis* for diagnosis and therapy of TB.

SUMMARY OF THE INVENTION

The present invention is directed to immunodominant antigens from *M. tuberculosis* wherein the antigens are known to react, that is, have known reactivities (and particularly known relative reactivities) to serum of a population of patients infected with the pathogen. Thus, the antigens presented herein will have a statistically high probability to elicit an immune response in a relatively large group of patients. Further, where the antigens are determined from selected subpopulations (e.g., active stage, latent stage, past infection, prior vaccination, not infected, co-infection with other pathogen, etc.), the antigens may also have a known association with a disease parameter.

In aspect of the inventive subject matter, an antigen composition comprises a plurality of antigens of *M. tuberculosis* encoded by nucleic acids selected from the group consisting of SEQ ID NO:1 to SEQ ID NO:586 (or any subgroup of such sequences), or fragments thereof, wherein at least two of the antigens elicit an immune response.

In other contemplated aspects of the inventive subject matter, an antigen composition comprises two or more immunodominant antigens of a pathogenic organism and are associated with a carrier, wherein the antigens have quantified and known relative reactivities with respect to sera of a population infected with the organism, and wherein the antigens have a known association with a disease parameter. Most preferably, immunodominant antigens are polypeptides and are encoded by nucleic acids having a sequence according to SEQ ID NO:1 to SEQ ID NO:586 (or comprise fragments thereof).

It is further contemplated that the known reactivities may be characterized by a variety of factors, however, it is particularly preferred that the known reactivities are characterized by strength of immunogenicity and/or time course of the infection. It is generally preferred that the parameter is activity state of the disease, a previous exposure to the pathogen, the duration of exposure to the pathogen, a chronic infection, past disease, active infection, inactive infection, at least partial immunity to infection with the pathogen, and/or outcome upon treatment.

In another aspect of the inventive subject matter, the carrier is a pharmaceutically acceptable carrier, and the composition is formulated as a vaccine. In such aspects, it is generally preferred that the vaccine comprises multiple (e.g., at least two, four, or six) antigens. It is still further contemplated that the antigens or fragments thereof are at least partially purified and/or recombinant.

In further contemplated aspects, the carrier may also be a solid carrier, and the plurality of antigens is disposed on the carrier either as a mixture or as an array. In such arrays, it is generally preferred that the antigens have at least two distinct known reactivities and/or parameters. It is also contemplated that the antigens or fragments thereof may be in crude expression extracts, in partially purified form (e.g., purity of less than 60%), or in highly purified form (e.g., purity of at least 95%). The antigens in such arrays may be recombinant or native. Alternatively, solid phases need not be limited to planar arrays, but may also include beads, columns, dipstick-type formats, etc.

Aspects of this invention include diagnostic assay utilizing at least two immunodominant antigens of *M. tuberculosis*. Antibody assays comprise contacting a sample of bodily fluid that contains antibodies against *M. tuberculosis*, for example, serum, with at least two immunodominant antigens of this invention and detecting antigen-antibody binding by any satisfactory method, preferably by formation of a color or generation of a fluorescent signal. For example, antigens immobilized on a solid surface, either individually in discrete areas or in a mixture, may be used to immobilize antibodies from the sample, and an anti-antibody linked directly or indirectly to a color-forming enzyme may then be added for signal generation in the standard ELISA format. Alternatively, fluorescence signals may be generated by methods such as linking (directly or indirectly) an anti-antibody to a fluorescence-emitting substance. Aspects of this invention also include use of at least two immunodominant antigens free in solution rather than immobilized on a surface. For example, a sample of peripheral blood, a bodily fluid containing T-lymphocytes, may be contacted with such antigens in vitro. Reactions between T-lymphocytes and antigen (on an antigen-presenting cell) are, like antigen-antibody reactions, epitope-specific even though T-lymphocytes and antibodies may recognize different epitopes. If the antigens are recognized, the T-lymphocytes produce at least one cytokine, such as interferon gamma, which is then detected by a (directly or indirectly) labeled antibody. Aspects of this invention further include kits of reagents for performing assays. Such kits include at least two immunodominant antigens according to this invention.

Various objects, features, aspects and advantages of the inventive subject matter will become more apparent from the following detailed description of preferred embodiments, along with the accompanying drawing figures in which like numerals represent like components.

BRIEF DESCRIPTION OF THE DRAWING

FIG. 2C is a table listing selected TB antigens using one preferred exemplary ranking algorithm.

FIGS. 4A and 4B depict the proteins ranking in random forests, CERNO, and random forests with CERNO-prefiltered data.

DETAILED DESCRIPTION

Figures 1A, 1B:
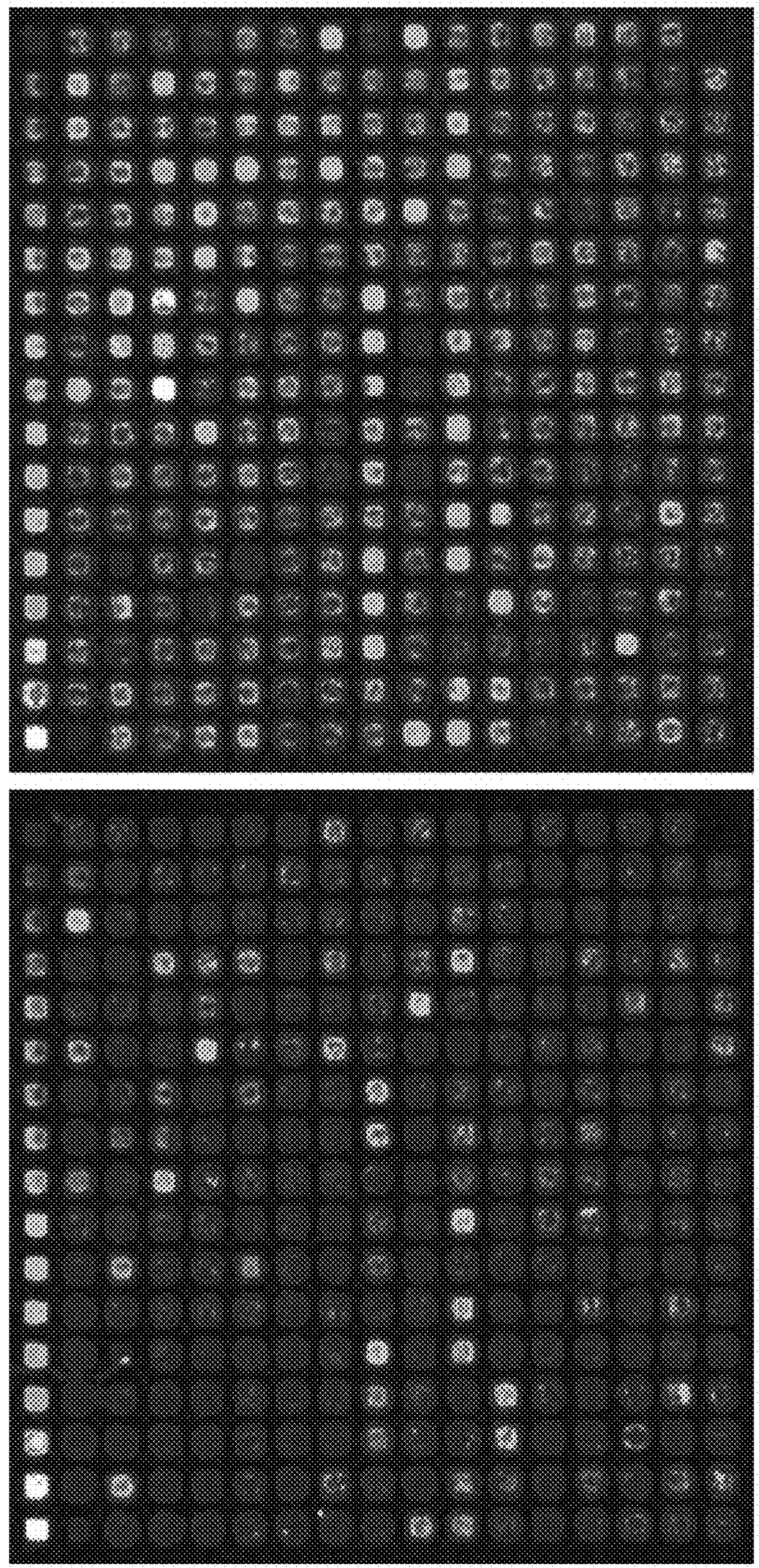
FIGS. 1A and 1B depict exemplary microarrays probed with sera from TB-positive and LTBI-negative (i.e., not infected with *M. tuberculosis*) individuals, respectively.

The inventors have discovered various immunodominant antigens from *M. tuberculosis* that are suitable for diagnostic and therapeutic purposes. Particularly preferred immunodominant antigens and are those encoded by nucleic acids having a sequence according to SEQ ID NO:1 to SEQ ID NO:586, and it is generally contemplated that such antigens can be used as single antigens, or in combination (optionally also in combination with antigens from another pathogen) in the manufacture of various diagnostic devices, therapeutic compositions, and vaccines. Preferably, the immunodominant antigens suitable for diagnostic and therapeutic purposes are encoded by the sequences designated Rv0798c (SEQ ID NO:121), Rv1886c (SEQ ID NO:270), Rv2031c (SEQ ID NO:284), Rv3616c (SEQ ID NO:509), Rv3804c (SEQ ID NO:534), Rv3874 (SEQ ID NO:547), Rv0302 (SEQ ID NO:52), Rv0379 (SEQ ID NO:65), Rv0394c (SEQ ID NO:66), Rv0456c (SEQ ID NO:74), Rv0632c (SEQ ID NO:103), Rv0944 (SEQ ID NO:142), Rv0984 (SEQ ID NO:146), Rv1030 (SEQ ID NO:153), Rv1196 (SEQ ID NO:174), Rv1242 (SEQ ID NO:180), Rv1284 (SEQ ID NO:187), Rv1387 (SEQ ID NO:206), Rv1837c (SEQ ID NO:264), Rv1926c (SEQ ID NO:275), Rv1980c (SEQ ID NO:281), Rv2094c (SEQ ID NO:294), Rv2544 (SEQ ID NO:363), Rv2618 (SEQ ID NO:375), Rv2746c (SEQ ID NO:391), Rv2870c (SEQ ID NO:407), Rv2873 (SEQ ID NO:408), Rv2875 (SEQ ID NO:409), Rv3050c (SEQ ID NO:434), Rv3248c (SEQ ID NO:458), Rv3376 (SEQ ID NO:478), Rv3763 (SEQ ID NO:527), Rv3810 (SEQ ID NO:536), Rv3864 (SEQ ID NO:545), Rv2252 (SEQ ID NO:323), Rv2282c (SEQ ID NO:569), Rv0212c (SEQ ID NO:557), Rv3243c (SEQ ID NO:456), Rv3675 (SEQ ID NO:519), Rv2984 (SEQ ID NO:423), Rv1175c (SEQ ID NO:169), Rv3326 (SEQ ID NO:578), Rv3628 (SEQ ID NO:513), Rv3775 (SEQ ID NO:584), Rv3362c (SEQ ID NO:475), Rv0801 (SEQ ID NO:122), Rv1629 (SEQ ID NO:566), Rv0272c (SEQ ID NO:558), Rv3762c (SEQ ID NO:583), Rv3319 (SEQ ID NO:577), Rv3495c (SEQ ID NO:581), Rv2151c (SEQ ID NO:308), Rv0227c (SEQ ID NO:37), Rv0280 (SEQ ID NO:50), Rv0993 (SEQ ID NO:148), Rv1306 (SEQ ID NO:192), Rv1363c (SEQ ID NO:204), Rv2050 (SEQ ID NO:288), Rv2116 (SEQ ID NO:299), Rv3417c (SEQ ID NO:486), Rv3653 (SEQ ID NO:516), Rv1253 (SEQ ID NO:182), Rv3413c (SEQ ID NO:485), Rv1635c (SEQ ID NO:232), Rv3021c (SEQ ID NO:432), Rv1193 (SEQ ID NO:173), Rv2592c (SEQ ID NO:369), Rv3620c (SEQ ID NO:510), Rv0929 (SEQ ID NO:139), Rv0959 (SEQ ID NO:145), Rv1162 (SEQ ID NO:166), Rv2389c (SEQ ID NO:341), Rv2984 (SEQ ID NO:423), Rv2588c (SEQ ID NO:367), Rv0171 (SEQ ID NO:26), Rv1865c (SEQ ID NO:267), Rv2074 (SEQ ID NO:290), Rv0543c (SEQ ID NO:87), Rv1677 (SEQ ID NO:237), Rv1304 (SEQ ID NO:191), Rv2841c (SEQ ID NO:400), Rv3680 (SEQ ID NO:520), Rv0831c (SEQ ID NO:125), Rv2032 (SEQ ID NO:285), Rv3127 (SEQ ID NO:446), Rv3272 (SEQ ID NO:464), Rv3323c (SEQ ID NO:470), Rv3508 (SEQ ID NO:494), Rv3628 (SEQ ID NO:513), Rv1173 (SEQ ID NO:167), Rv2623 (SEQ ID NO:376), Rv0527 (SEQ ID NO:85), Rv1620c (SEQ ID NO:229), Rv1901 (SEQ ID NO:272), Rv2151c (SEQ ID NO:308), Rv0362 (SEQ ID NO:60), Rv3129 (SEQ ID NO:447), Rv3140 (SEQ ID NO:449), Rv0340 (SEQ ID NO:56), Rv2792c (SEQ ID NO:395), Rv3003c (SEQ ID NO:426), Rv3019c (SEQ ID NO:431), Rv3862c (SEQ ID NO:544), Rv0572c (SEQ ID NO:91), Rv2477c (SEQ ID NO:356), Rv2659c (SEQ ID NO:379), Rv0311 (SEQ ID NO:54), Rv0350 (SEQ ID NO:57), Rv2127 (SEQ ID NO:301), Rv3875 (SEQ ID NO:548), Rv0877 (SEQ ID NO:134), Rv1916 (SEQ ID NO:274), Rv2138 (SEQ ID NO:303), Rv2847c (SEQ ID NO:403), Rv3118 (SEQ ID NO:444), Rv2495c (SEQ ID NO:358), Rv3669 (SEQ ID NO:517), Rv0281 (SEQ ID NO:51), Rv2711 (SEQ ID NO:383), Rv2744c (SEQ ID NO:390), Rv3803c (SEQ ID NO:533), Rv1239c (SEQ ID NO:179), Rv2147c (SEQ ID NO:307), Rv2253 (SEQ ID NO:324), Rv0308 (SEQ ID NO:53), Rv0587 (SEQ ID NO:95), Rv1564c (SEQ ID NO:224), Rv2185c (SEQ ID NO:313), Rv1805c (SEQ ID NO:261), Rv2729c (SEQ ID NO:386), Rv3386 (SEQ ID NO:481), Rv3515c (SEQ ID NO:497), Rv0772 (SEQ ID NO:116), Rv2948c (SEQ ID NO:420), Rv0006 (SEQ ID NO:1), Rv1906c (SEQ ID NO:273), Rv2244 (SEQ ID NO:322), Rv2468c (SEQ ID NO:354), Rv3701c (SEQ ID NO:522), Rv0054 (SEQ ID NO:6), Rv1945 (SEQ ID NO:277), Rv3345c (SEQ ID NO:472), Rv0276 (SEQ ID NO:48), Rv0709 (SEQ ID NO:108), Rv1527c (SEQ ID NO:220), Rv2048c (SEQ ID NO:287), Rv2414c (SEQ ID NO:345), Rv3524 (SEQ ID NO:499), Rv3556c (SEQ ID NO:502), Rv1322 (SEQ ID NO:196), Rv2934 (SEQ ID NO:417), Rv0270 (SEQ ID NO:47), Rv0612 (SEQ ID NO:99), Rv1699 (SEQ ID NO:242), Rv2728c (SEQ ID NO:385), Rv3017c (SEQ ID NO:430), Rv3364c (SEQ ID NO:476), Rv3418c (SEQ ID NO:487), Rv3718c (SEQ ID NO:525), Rv0426c (SEQ ID NO:70), Rv1181 (SEQ ID NO:171), Rv1725c (SEQ ID NO:250), Rv0256c (SEQ ID NO:44), Rv0605 (SEQ ID NO:98), Rv0737 (SEQ ID NO:114), Rv0834c (SEQ ID NO:126), Rv1255c (SEQ ID NO:184), Rv2224c (SEQ ID NO:320), Rv1843c (SEQ ID NO:265), Rv2333c (SEQ ID NO:334), Rv2490c (SEQ ID NO:357), Rv3183 (SEQ ID NO:454), Rv0668 (SEQ ID NO:106), Rv1556 (SEQ ID NO:223), Rv1673c (SEQ ID NO:236), Rv3513c (SEQ ID NO:496), Rv3675 (SEQ ID NO:519), Rv3870 (SEQ ID NO:546), Rv3891c (SEQ ID NO:552), Rv0163 (SEQ ID NO:24), Rv0710 (SEQ ID NO:109), Rv1297 (SEQ ID NO:189), Rv1745c (SEQ ID NO:255), Rv0600c (SEQ ID NO:97), Rv1536 (SEQ ID NO:222), Rv1738 (SEQ ID NO:254), Rv2524c (SEQ ID NO:359), Rv3086 (SEQ ID NO:440), Rv3367 (SEQ ID NO:477), Rv0135c (SEQ ID NO:20), Rv0627 (SEQ ID NO:101), Rv1448c (SEQ ID NO:213), Rv3224a (SEQ ID NO:455), Rv0029 (SEQ ID NO:2), Rv0846c (SEQ ID NO:129), Rv1159 (SEQ ID NO:165), Rv1186c (SEQ ID NO:172), Rv1705c (SEQ ID NO:243), Rv1713 (SEQ ID NO:248), Rv2476c (SEQ ID NO:355), Rv3402c (SEQ ID NO:483), Rv2615c (SEQ ID NO:374), Rv2995c (SEQ ID NO:425), Rv3788 (SEQ ID NO:585), Rv0140 (SEQ ID NO:555), Rv0203 (SEQ ID NO:33), Rv1531 (SEQ ID NO:565), Rv1693 (SEQ ID NO:241), Rv1882c (SEQ ID NO:269), Rv2143 (SEQ ID NO:568), Rv2367c (SEQ ID NO:570), Rv0584 (SEQ ID NO:94), Rv1651c (SEQ ID NO:567), Rv3197a (SEQ ID NO:576), Rv3369 (SEQ ID NO:579), Rv3825c (SEQ ID NO:586), Rv0101 (SEQ ID NO:15), Rv0808 (SEQ ID NO:123), Rv0814c (SEQ ID NO:560), Rv2153c (SEQ ID NO:309), Rv2933 (SEQ ID NO:416), Rv0071 (SEQ ID NO:9), Rv2471 (SEQ ID NO:571), Rv2979c (SEQ ID NO:575), Rv0155 (SEQ ID NO:556), Rv0581 (SEQ ID NO:559), Rv2631 (SEQ ID NO:377), Rv3455c (SEQ ID NO:489), Rv3601c (SEQ ID NO:505), Rv0896 (SEQ ID NO:562), Rv1641 (SEQ ID NO:234), Rv3005c (SEQ ID NO:427), Rv3759c (SEQ ID NO:582), Rv3800c (SEQ ID NO:532), Rv0187 (SEQ ID NO:30), Rv2379c (SEQ ID NO:338), Rv2434c (SEQ ID NO:352), Rv2940c (SEQ ID NO:574), Rv3477 (SEQ ID NO:580), Rv0435c (SEQ ID NO:72), Rv0844c (SEQ ID NO:128), Rv0856 (SEQ ID NO:561), Rv1191 (SEQ ID NO:564), Rv2803 (SEQ ID NO:397), Rv0783c (SEQ ID NO:118), Rv1054 (SEQ ID NO:563), Rv1689 (SEQ ID NO:240), Rv2539c (SEQ ID NO:572), Rv2859c (SEQ ID NO:573), Rv3777 (SEQ ID NO:528), and fragments thereof. Most preferably, the immunodominant antigens are encoded by sequences designated Rv0798c (SEQ ID NO:121); Rv1886c (SEQ ID NO:270); Rv2031c (SEQ ID NO:284); Rv3616c (SEQ ID NO:509); Rv3804c (SEQ ID NO:534); and Rv3874 (SEQ ID NO:547).

As used herein, the term "immunodominant antigen" refers to an antigen that elicits in at least one stage of the infection production of one or more types of antibodies (e.g., IgG, IgA, IgE, IgM, etc.) in at least 20%, more typically at least 40%, and most typically at least 70% of a population exposed to the antigen, or wherein, when compared to other antigens of the same pathogen, the average binding affinity and/or average quantity of the antibodies produced in the patient in at least one stage of the disease is at least in the upper half, more typically upper tertile, and most typically upper quartile. Most typically, the average binding affinity and/or average quantity of the antibodies is reflected in the signal intensity and signal intensity can therefore be used as a surrogate marker for average binding affinity and/or average quantity of the antibodies. In further aspects, preferred immunodominant antigens are also characterized by a response in the test group that is considered statistically significant when compared with control signal intensity, wherein the significance level p is preferably equal or less than 0.1, more preferably equal or less than 0.05, and most preferably equal or less than 0.01.

In one aspect of the inventive subject matter, immunodominant antigens are identified from a proteome screen against sera of a population that has been previously exposed to the pathogen. Most preferably, the population is subdivided in several sub-populations to reflect various disease parameters (e.g., active disease, bacillary burden of disease, latent infection, presence of co-infection with HIV, absence of infection, etc.), which can then be correlated with antibody responses to the so identified antigens. It is still further preferred that the screening also provides data on relative reactivities with respect to the antigens and sera of the populations/sub-populations.

It is generally preferred that at least part of the pathogen's genome is obtained and all potential open reading frames and portions thereof are determined in silico. Once the potential genes are identified, suitable primers are determined to provide amplicons of the entire Open Reading Frames (ORFs), or, less preferably, portions thereof, wherein the primers are preferably designed to allow facile subcloning into an expression system. Most preferably, the subcloning uses recombinase-based subcloning using unpurified PCR mixtures to avoid cloning bias, and the so obtained recombinant plasmids are polyclonally multiplied, which enables unbiased presentation of the amplicons. It is still further particularly preferred that the plasmid preparations are then subjected to an in vitro transcription/translation reaction to thereby provide the recombinant ORF peptide, which is then spotted or otherwise immobilized onto a suitable addressable carrier (e.g., membrane, bead, etc.).

It should be recognized that the so prepared proteomes can then be exposed to serum of a population of control individuals and/or population of individuals that are known to have current or previous exposure to the above pathogen from which the ORFs were prepared. Antibodies of the serum that bind to one or more of the ORFs are then detected using well known methods (e.g., use of secondary antibodies). In this manner, the entire proteome of the pathogen can be rapidly assessed for immunogenicity and potential binding with antibodies in serum. Various preferred aspects, compositions, and methods of proteome preparation are disclosed in International patent publication number WO 06/088492, which is incorporated by reference herein.

Therefore, and among various other advantages, it should be especially recognized that contemplated compositions and methods presented herein will allow for preparation of vaccines and diagnostic compositions comprising a plurality of antigens with known and predetermined affinity to target ORFs of a pathogen. As individual immune systems are known to exhibit significant variation with respect to antigen recognition, methods and compositions contemplated herein will allow statistically supported antigen identification to identify immunodominant antigens in a population of patient. Consequently, multiple targets can be used to elicit an immune response and/or detect a prior exposure, even where one or more of the targets may be evasive for detection or provide only a weak response.

With respect to the immunodominant sequences identified herein, it should be further appreciated that the sequences need not be complete ORFs, but that suitable sequences may also be partial sequences (e.g., synthetic, recombinant or isolated) that typically comprise at least part of an antigenic epitope. For example, contemplated DNA sequences include those that will hybridize under stringent hybridization conditions to respective sequences listed in the sequence listing. Thus, sequences contemplated herein may be identified as DNA sequences encoding the antigenic peptide (partial or entire ORF), or may be identified as peptide sequence (or homologs thereof). Similarly, chemically modified antigens, and/or orthologs of the polypeptides presented herein are also deemed suitable for use herein.

It should be particularly noted that while proteome screening will provide a plurality of antigens as potentially useful molecules for diagnosis, vaccination, and/or therapy, such an approach only provides a raw cut of (a plurality) of individual responses. Therefore, as most individual immune reactions towards the same pathogen elicit a significantly distinct profile of antibodies (e.g., depending on disease stage, previous exposure, and/or inter-individual variability), results obtained from such screening are typically inhomogeneous. Consequently, variability of the individual immune responses and variability of the quantity of recombinant protein in the array must be taken into consideration to obtain meaningful results.

Therefore, it should be appreciated that filtering of raw data will result in a collection of antigens with quantified and known relative reactivities with respect to sera of a population infected with the pathogen. Moreover, it should be noted that as signals may be specific to a particular stage in the course of an infection, relative reactivities may be indicative of the time course of the infection, and/or relative reactivities may represent differences in the strength of immunogenicity of the particular antigen (or quantity of deposited antigen in the screening assay). Additionally, it should be particularly recognized that depending on the choice of the specific patient population, the tested sera will reflect the immune status of a population that is characterized by one or more parameters of the disease. For example, populations may be observed that are infected or not infected, that had a long-term exposure or chronic infection, that had spontaneous recovery, that represents a group of responders (or non-responders) to a particular drug treatment, or that had at least partial immunity to the pathogen.

In still further contemplated aspects, immunodominant antigens are identified by selecting for an antigen (preferably within a well-defined sub-population) that (a) produces in at least 40-50% of a population a measurable signal, and (b) has a signal strength of at least 40% of the overall average signal intensity. However, and more preferably, the signal strength will be at least above average of the overall average signal intensity, and even more preferably in the upper tertile (quartile, or even quintile) of signal intensities in the assay. Therefore, and viewed from another perspective, immunodominant antigens will preferably be selected in a comparison of at least two series of tests, wherein one series of tests is typically the sub-population (e.g., primary infection, active disease, latent infection, recovering, previously diseased, chronic, etc.) and the other series of tests is the control group (e.g., other sub-population or control group). Still further, it is generally preferred that the series of tests also include a negative control against which the potential immunodominant antigens are compared.

Consequently, and with particular respect to the pathogen presented herein, it should be appreciated that compositions comprising one or more selected immunodominant antigens can be prepared that will have a statistically high probability to elicit or have elicited an immune response in a relatively large group of patients. Further, where the antigens are determined from selected sub-populations (e.g., active disease, severity of disease, latent infection, previously diseased patients, primary infection, etc.), the antigens also have a known association with a disease parameter and thus allow staging of the disease and/or prediction of therapeutic efficacy. Moreover, as the antigens presented herein are immunodominant antigens, it should be noted that vaccine compositions can be prepared with known or predictable immunogenicity.

More specifically, antigens from *M. tuberculosis* encoded by the nucleic acids of SEQ ID NO:1 to SEQ ID NO:586 were identified as immunodominant (see examples below). With respect to the reading frame for each of the sequences of SEQ ID NO:1 to SEQ ID NO:586, it should be noted that the first base in the sequences is either the first base of the start codon or the first base in the first codon of the polypeptide that was identified with the methods and compositions provided herein. Most typically, the last three bases denote the stop codon, or the last base of the last codon of the polypeptide that was identified with the methods and compositions provided herein.

Figure 5:
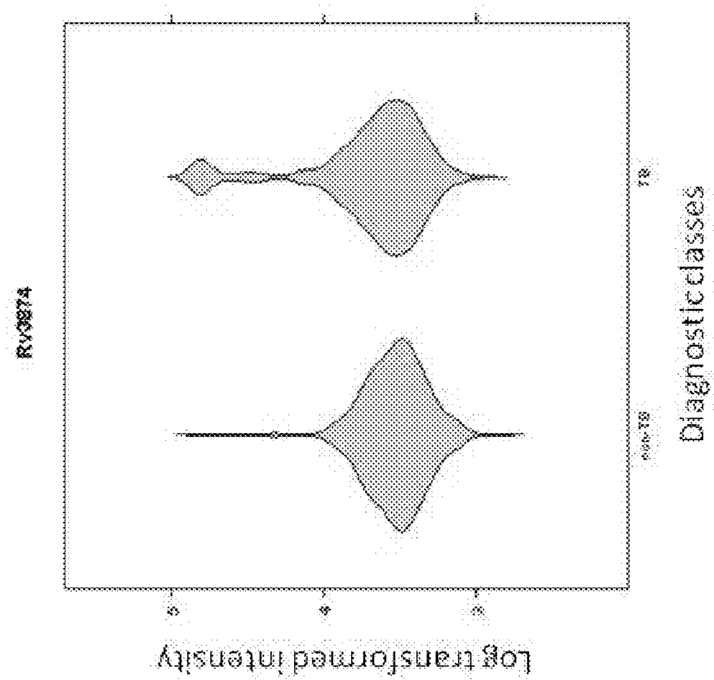
FIG. 5 depicts a protein which exhibits a tail distribution of higher intensity signals in TB samples that is not seen in non-TB samples.

In these examples, each of the antigens was characterized, inter alia, with regard to their individual and relative reactivities for the pathogen. Most typically, reactivity was measured as strength of immunogenicity (e.g., such that average binding affinity and/or average quantity of the antibodies produced a predetermined signal intensity (e.g., in the upper half, upper tertile, or even upper quartile)). Viewed from a different perspective, each one of the identified antigens has a known signal strength (reflecting the quantity of antibodies formed in the patient) in the assay as described below relative to another one of the identified antigens. Some proteins, such as the one depicted in FIG. 5, exhibit a tail distribution of higher intensity signals in TB samples that is not seen in non-TB samples. These two violin plots show the distribution of log 10-transformed signal intensities measured for a representative protein in sera from TB cases vs. sera from non-TB disease cases. Proteins having this characteristic distribution were identified on the examples described below by implementing a calculation whereby the null hypothesis could be rejected that the profile of a sample comprised only reactivity values consistent with the non-TB intensity distribution.

Furthermore, each of the identified antigens was also characterized by association with at least one parameter. In most cases, the disease parameter was active disease after infection, and in further cases, the disease parameter was number of tubercle bacilli in sputum or radiographic extent of disease, and in further cases, history of past disease in the non-diseased population. Therefore, it should be especially appreciated that identification of immunodominant antigens will not only allow for identification of statistically meaningful antigens for diagnosis, vaccine development, and treatment, but also allow to develop a stage specific tool to identify candidate molecules to fine-tune diagnosis and/or treatment.

For example, suitable diagnostic devices especially include those comprising one or more of the immunodominant antigens, fragments, or analogs thereof that are encoded by nucleic acids according to SEQ ID NO:1 to SEQ ID NO:586, preferably Rv0798c (SEQ ID NO:121), Rv1886c (SEQ ID NO:270), Rv2031c (SEQ ID NO:284), Rv3616c (SEQ ID NO:509), Rv3804c (SEQ ID NO:534), Rv3874 (SEQ ID NO:547), Rv0302 (SEQ ID NO:52), Rv0379 (SEQ ID NO:65), Rv0394c (SEQ ID NO:66), Rv0456c (SEQ ID NO:74), Rv0632c (SEQ ID NO:103), Rv0944 (SEQ ID NO:142), Rv0984 (SEQ ID NO:146), Rv1030 (SEQ ID NO:153), Rv1196 (SEQ ID NO:174), Rv1242 (SEQ ID NO:180), Rv1284 (SEQ ID NO:187), Rv1387 (SEQ ID NO:206), Rv1837c (SEQ ID NO:264), Rv1926c (SEQ ID NO:275), Rv1980c (SEQ ID NO:281), Rv2094c (SEQ ID NO:294), Rv2544 (SEQ ID NO:363), Rv2618 (SEQ ID NO:375), Rv2746c (SEQ ID NO:391), Rv2870c (SEQ ID NO:407), Rv2873 (SEQ ID NO:408), Rv2875 (SEQ ID NO:409), Rv3050c (SEQ ID NO:434), Rv3248c (SEQ ID NO:458), Rv3376 (SEQ ID NO:478), Rv3763 (SEQ ID NO:527), Rv3810 (SEQ ID NO:536), Rv3864 (SEQ ID NO:545), Rv2252 (SEQ ID NO:323), Rv2282c (SEQ ID NO:569), Rv0212c (SEQ ID NO:557), Rv3243c (SEQ ID NO:456), Rv3675 (SEQ ID NO:519), Rv2984 (SEQ ID NO:423), Rv1175c (SEQ ID NO:169), Rv3326 (SEQ ID NO:578), Rv3628 (SEQ ID NO:513), Rv3775 (SEQ ID NO:584), Rv3362c (SEQ ID NO:475), Rv0801 (SEQ ID NO:122), Rv1629 (SEQ ID NO:566), Rv0272c (SEQ ID NO:558), Rv3762c (SEQ ID NO:583), Rv3319 (SEQ ID NO:577), Rv3495c (SEQ ID NO:581), Rv2151c (SEQ ID NO:308), Rv0227c (SEQ ID NO:37), Rv0280 (SEQ ID NO:50), Rv0993 (SEQ ID NO:148), Rv1306 (SEQ ID NO:192), Rv1363c (SEQ ID NO:204), Rv2050 (SEQ ID NO:288), Rv2116 (SEQ ID NO:299), Rv3417c (SEQ ID NO:486), Rv3653 (SEQ ID NO:516), Rv1253 (SEQ ID NO:182), Rv3413c (SEQ ID NO:485), Rv1635c (SEQ ID NO:232), Rv3021c (SEQ ID NO:432), Rv1193 (SEQ ID NO:173), Rv2592c (SEQ ID NO:369), Rv3620c (SEQ ID NO:510), Rv0929 (SEQ ID NO:139), Rv0959 (SEQ ID NO:145), Rv1162 (SEQ ID NO:166), Rv2389c (SEQ ID NO:341), Rv2984 (SEQ ID NO:423), Rv2588c (SEQ ID NO:367), Rv0171 (SEQ ID NO:26), Rv1865c (SEQ ID NO:267), Rv2074 (SEQ ID NO:290), Rv0543c (SEQ ID NO:87), Rv1677 (SEQ ID NO:237), Rv1304 (SEQ ID NO:191), Rv2841c (SEQ ID NO:400), Rv3680 (SEQ ID NO:520), Rv0831c (SEQ ID NO:125), Rv2032 (SEQ ID NO:285), Rv3127 (SEQ ID NO:446), Rv3272 (SEQ ID NO:464), Rv3323c (SEQ ID NO:470), Rv3508 (SEQ ID NO:494), Rv3628 (SEQ ID NO:513), Rv1173 (SEQ ID NO:167), Rv2623 (SEQ ID NO:376), Rv0527 (SEQ ID NO:85), Rv1620c (SEQ ID NO:229), Rv1901 (SEQ ID NO:272), Rv2151c (SEQ ID NO:308), Rv0362 (SEQ ID NO:60), Rv3129 (SEQ ID NO:447), Rv3140 (SEQ ID NO:449), Rv0340 (SEQ ID NO:56), Rv2792c (SEQ ID NO:395), Rv3003c (SEQ ID NO:426), Rv3019c (SEQ ID NO:431), Rv3862c (SEQ ID NO:544), Rv0572c (SEQ ID NO:91), Rv2477c (SEQ ID NO:356), Rv2659c (SEQ ID NO:379), Rv0311 (SEQ ID NO:54), Rv0350 (SEQ ID NO:57), Rv2127 (SEQ ID NO:301), Rv3875 (SEQ ID NO:548), Rv0877 (SEQ ID NO:134), Rv1916 (SEQ ID NO:274), Rv2138 (SEQ ID NO:303), Rv2847c (SEQ ID NO:403), Rv3118 (SEQ ID NO:444), Rv2495c (SEQ ID NO:358), Rv3669 (SEQ ID NO:517), Rv0281 (SEQ ID NO:51), Rv2711 (SEQ ID NO:383), Rv2744c (SEQ ID NO:390), Rv3803c (SEQ ID NO:533), Rv1239c (SEQ ID NO:179), Rv2147c (SEQ ID NO:307), Rv2253 (SEQ ID NO:324), Rv0308 (SEQ ID NO:53), Rv0587 (SEQ ID NO:95), Rv1564c (SEQ ID NO:224), Rv2185c (SEQ ID NO:313), Rv1805c (SEQ ID NO:261), Rv2729c (SEQ ID NO:386), Rv3386 (SEQ ID NO:481), Rv3515c (SEQ ID NO:497), Rv0772 (SEQ ID NO:116), Rv2948c (SEQ ID NO:420), Rv0006 (SEQ ID NO:1), Rv1906c (SEQ ID NO:273), Rv2244 (SEQ ID NO:322), Rv2468c (SEQ ID NO:354), Rv3701c (SEQ ID NO:522), Rv0054 (SEQ ID NO:6), Rv1945 (SEQ ID NO:277), Rv3345c (SEQ ID NO:472), Rv0276 (SEQ ID NO:48), Rv0709 (SEQ ID NO:108), Rv1527c (SEQ ID NO:220), Rv2048c (SEQ ID NO:287), Rv2414c (SEQ ID NO:345), Rv3524 (SEQ ID NO:499), Rv3556c (SEQ ID NO:502), Rv1322 (SEQ ID NO:196), Rv2934 (SEQ ID NO:417), Rv0270 (SEQ ID NO:47), Rv0612 (SEQ ID NO:99), Rv1699 (SEQ ID NO:242), Rv2728c (SEQ ID NO:385), Rv3017c (SEQ ID NO:430), Rv3364c (SEQ ID NO:476), Rv3418c (SEQ ID NO:487), Rv3718c (SEQ ID NO:525), Rv0426c (SEQ ID NO:70), Rv1181 (SEQ ID NO:171), Rv1725c (SEQ ID NO:250), Rv0256c (SEQ ID NO:44), Rv0605 (SEQ ID NO:98), Rv0737 (SEQ ID NO:114), Rv0834c (SEQ ID NO:126), Rv1255c (SEQ ID NO:184), Rv2224c (SEQ ID NO:320), Rv1843c (SEQ ID NO:265), Rv2333c (SEQ ID NO:334), Rv2490c (SEQ ID NO:357), Rv3183 (SEQ ID NO:454), Rv0668 (SEQ ID NO:106), Rv1556 (SEQ ID NO:223), Rv1673c (SEQ ID NO:236), Rv3513c (SEQ ID NO:496), Rv3675 (SEQ ID NO:519), Rv3870 (SEQ ID NO:546), Rv3891c (SEQ ID NO:552), Rv0163 (SEQ ID NO:24), Rv0710 (SEQ ID NO:109), Rv1297 (SEQ ID NO:189), Rv1745c (SEQ ID NO:255), Rv0600c (SEQ ID NO:97), Rv1536 (SEQ ID NO:222), Rv1738 (SEQ ID NO:254), Rv2524c (SEQ ID NO:359), Rv3086 (SEQ ID NO:440), Rv3367 (SEQ ID NO:477), Rv0135c (SEQ ID NO:20), Rv0627 (SEQ ID NO:101), Rv1448c (SEQ ID NO:213), Rv3224a (SEQ ID NO:455), Rv0029 (SEQ ID NO:2), Rv0846c (SEQ ID NO:129), Rv1159 (SEQ ID NO:165), Rv1186c (SEQ ID NO:172), Rv1705c (SEQ ID NO:243), Rv1713 (SEQ ID NO:248), Rv2476c (SEQ ID NO:355), Rv3402c (SEQ ID NO:483), Rv2615c (SEQ ID NO:374), Rv2995c (SEQ ID NO:425), Rv3788 (SEQ ID NO:585), Rv0140 (SEQ ID NO:555), Rv0203 (SEQ ID NO:33), Rv1531 (SEQ ID NO:565), Rv1693 (SEQ ID NO:241), Rv1882c (SEQ ID NO:269), Rv2143 (SEQ ID NO:568), Rv2367c (SEQ ID NO:570), Rv0584 (SEQ ID NO:94), Rv1651c (SEQ ID NO:567), Rv3197a (SEQ ID NO:576), Rv3369 (SEQ ID NO:579), Rv3825c (SEQ ID NO:586), Rv0101 (SEQ ID NO:15), Rv0808 (SEQ ID NO:123), Rv0814c (SEQ ID NO:560), Rv2153c (SEQ ID NO:309), Rv2933 (SEQ ID NO:416), Rv0071 (SEQ ID NO:9), Rv2471 (SEQ ID NO:571), Rv2979c (SEQ ID NO:575), Rv0155 (SEQ ID NO:556), Rv0581 (SEQ ID NO:559), Rv2631 (SEQ ID NO:377), Rv3455c (SEQ ID NO:489), Rv3601c (SEQ ID NO:505), Rv0896 (SEQ ID NO:562), Rv1641 (SEQ ID NO:234), Rv3005c (SEQ ID NO:427), Rv3759c (SEQ ID NO:582), Rv3800c (SEQ ID NO:532), Rv0187 (SEQ ID NO:30), Rv2379c (SEQ ID NO:338), Rv2434c (SEQ ID NO:352), Rv2940c (SEQ ID NO:574), Rv3477 (SEQ ID NO:580), Rv0435c (SEQ ID NO:72), Rv0844c (SEQ ID NO:128), Rv0856 (SEQ ID NO:561), Rv1191 (SEQ ID NO:564), Rv2803 (SEQ ID NO:397), Rv0783c (SEQ ID NO:118), Rv1054 (SEQ ID NO:563), Rv1689 (SEQ ID NO:240), Rv2539c (SEQ ID NO:572), Rv2859c (SEQ ID NO:573), Rv3777 (SEQ ID NO:528).

Depending on the particular device format, the device may have only a single immunodominant antigen, fragment, or analog that may be used for detection of binding of antibodies from blood, plasma or serum or other bodily fluids containing antibody in an automated manner or by visual observation. For example, where a single immunodominant antigen is employed, suitable devices may be in the format of a dipstick or competitive ELISA. On the other hand, where multiple immunodominant antigens are employed, suitable devices may be in the format of an array that can be read in an automated device (e.g., via scanner) or visual manner (e.g., dye-forming colorimetric reaction). Most typically, in such devices, the plurality of antigens is deposited in a spatially addressable manner (e.g., x-y matrix or beads with color association or microtiter plate). Moreover, it should be noted that diagnostic devices contemplated herein may be based on numerous well known manners of detection, including ELISA (sandwich or non-sandwich), competitive ELISA, anti-idiotypic antibodies, etc., wherein all known calorimetric and photometric (e.g., fluorescence, luminescence, etc.) or radiometric reactions are deemed suitable for use.

In most typical devices, a plurality of immunodominant antigens of a single (or multiple) pathogen and/or serotype are deposited on a solid surface or onto an addressable solid phase and exposed to blood, serum, plasma or other antibody-containing body fluid. Consequently, so prepared compositions can be employed to identify and/or characterize an immune response of an individual against selected antigens, and optionally assess the kind of immune response (e.g., identification of latent or chronic infection), as well as disease progression, efficacy of therapy, etc. Most typically, the plurality of antigens will include between 5 to 10 antigens, but significantly higher amounts of antigens are also contemplated, including at least 25%, more typically at least 50%, even more typically at least 75%, and most typically at least 90% of the proteome of the pathogen. Similarly, less than 5 antigens (1-4) are also deemed suitable. In further typical aspects of the inventive subject matter, contemplated arrays are most preferably processed in a microfluidic device. For example, an array of antigens in such devices may be printed on a membrane or other material (e.g., nitrocellulose-coated carrier of less than 1 cm2 area) that is then placed in a microfluidic device having sample/reagent inlet and outlet ports. Depending on the specific configuration, signals may be acquired using optical methods (e.g., CCD chip, flat bed scanner, etc.), electrical methods (e.g., voltametric or amperometric), or other methods well known in the art. Alternatively, visual detection or detection using a regular flat bed scanner at 1200 dpi resolution and/or fluorescence detection is also deemed suitable.

In another example, immunodominant antigens according to the inventive subject matter may also be employed to generate an antibody preparation that can be used as passive vaccination for therapeutic treatment of tuberculosis. In preferred embodiments, such vaccines are subunit vaccines or attenuated live recombinant vaccines. For example, the immunodominant antigens presented herein may be employed in the manufacture of a vaccine that comprises at least one, and more typically at least two of the immunodominant antigens encoded by nucleic acids according to SEQ ID NO:1 to SEQ ID NO:586. More preferably, however, contemplated vaccines will include between two and five, or at least six, and even more antigens, of which at least one of the antigens is an immunodominant antigen. Such vaccine compositions may be directed to elicit immunity against single or multiple subtypes and may thus comprise distinct immunodominant antigens, optionally from multiple and distinct subtypes. Moreover, it should be appreciated that vaccines may be produced that predominantly, or even exclusively, comprise immunodominant antigens of a single parameter. For example, a vaccine may comprise immunodominant antigens that are characteristic for a population that has a latent infection. In less preferred aspects, the sequences according to SEQ ID NO:1 to SEQ ID NO:586 may also be employed as DNA vaccines, or be part of an in vivo expression system that triggers an immune response against the in vivo produced recombinant antigen or fragment thereof.

Additionally, it is contemplated that antigens identified herein may also be employed to generate (monoclonal or polyclonal) antibodies or fragments thereof (e.g., Fab, scFv, etc.) that can then be employed in a diagnostic test that directly detects the presence of the antigen in blood, blood derivatives or other body fluid of a patient where the antigen is circulating in the patient. Of course, it should be appreciated that the antigen may circulate in association with the pathogen, in association with components of the pathogen, in free form, or bound to a molecule or cell of the patient. Most preferably, the antigens are immunodominant and/or serodiagnostic antigens as presented herein. For example, suitable tests include those in which one or more labeled antibodies are used to detect presence of the antigen in bodily fluid where the antigen may be captured (specifically or in bulk with other proteins) on a surface. There are numerous antigen detection methods known in the art and all of the known formats are deemed suitable for use herein.

In certain embodiments, the diagnostic tools of the present invention involve the recognition of the immunodominant antigens described herein in an in vitro cellular assay determining the release of cytokines, such as interferon gamma, from lymphocytes withdrawn from a subject currently or previously infected with a virulent mycobacterium.

With respect to suitable formulations of vaccines, it should be recognized that all known manners of producing such vaccines are deemed appropriate for use herein, and a person of ordinary skill in the art will be readily able to produce such vaccines without undue experimentation (see e.g., "Vaccine Adjuvants and Delivery Systems" by Manmohan Singh; Wiley-Interscience (Jun. 29, 2007), ISBN: 0471739073; or "Vaccine Protocols" (Methods in Molecular Medicine) by Andrew Robinson, Martin P. Cranage, and Michael J. Hudson; Humana Press; 2 edition (Aug. 27, 2003); ISBN:

1588291405). Therefore, suitable vaccines may be formulated as injectable solutions, or suspensions, intranasal formulations, transdermal or oral formulations.

The compositions, vaccines, diagnostic tests, etc., described herein may be used for both human and veterinary use.

EXAMPLES

*M. tuberculosis* proteome microarray chip fabrication and probing methods: Proteome microarrays were fabricated as described previously (Proc Natl Acad Sci USA 102(3): 547-552; Proteomics 7(10): 1678-1686; Proteomics 7(13): 2172-2183) with modifications. This and all other extrinsic materials discussed herein are incorporated by reference in their entirety. Where a definition or use of a term in an incorporated reference is inconsistent or contrary to the definition of that term provided herein, the definition of that term provided herein applies and the definition of that term in the reference does not apply.

High-throughput construction of the *M. tuberculosis* ORFeome: Using the available *M. tuberculosis* sequence data primer pairs were designed for all ORFs encoded in the genome. Quality control was performed using gel electrophoresis of PCR products. After three rounds of PCR, the final tally was 97.3% successfully amplified. For cloning, PCR products were mixed with a linearized pXT7-based expression vector as described previously and transformed into supercompetent DH5α cells. The transformed cells were cultured at 37° C. with vigorous aeration and were checked for turbidity the following day. DNA was purified from the overnight cultures without prior colony selection using QIAprep 96 Turbo Miniprep Kits from Qiagen. Of the 3998 successfully amplified PCR products, 3858 were cloned into the pXi vector (96.5% efficiency). A random sample of 1064 clones were tested by 'QC-PCR' in which using the sequence-specific primers were again used to verify that the cloned inserts were the expected size. Of these, 1007 were verified (94.6%) using this methodology.

More specifically, 4109 primer pairs were designed to amplify every ORF in the *M. tuberculosis* (strain H37Rv) genome annotated in Tuberculist (http://genolist.pasteur.fr/TubercuList/). Custom PCR primers comprising 20 bp of gene-specific sequence with 33 bp of "adapter" sequences were used in PCRs with genomic DNA as template. For genes>3 kb, additional primer pairs were designed to amplify overlapping fragments of 3 kb each. All primer pairs used for this work are published at the UCI Institute for Genomics and Bioinformatics (IGB) web portal at http://contact14.ics.uci.edu/virus/tuber_index.php. The adapter sequences, which become incorporated into the termini flanking the amplified gene, are homologous to the cloning site of the linearized T7 expression vector pXT7 and allow the PCR products to be cloned by in vivo homologous recombination in competent DH5α cells. The resulting protein incorporates an ATG translation start codon, a 5' polyhistidine epitope, a 3' influenza hemagglutinin epitope and a T7 terminator.

Array fabrication: Antibodies against the N-terminal poly-His and the C-terminal HA tags engineered into each protein were used to monitor the expression in each spot. Positive and negative controls were built into every array and remaining spots on the array were in vitro transcription/translation reactions expressing 4109 different *M. tuberculosis* clones representing the entire cloned ORFeome. Once RTS reactions were printed onto nitrocellulose and dried, no appreciable degradation was observed after 6 months of storage in a desiccator at 18° C. (data not shown). However, a reduction in signal and a reduced signal-to-noise ratio associated with prolonged delay in printing after the end of the 5 h in vitro protein expression was observed. To minimize such reduction, in vitro expression reactions were staggered through the print run. Thus, it is generally preferred that the reactions are no more than 5, more preferably no more than 3, and most preferably no more than 1 hour old before printing. Remaining variance in signals was normalized using positive and negative controls as described below.

Microarray chips were fabricated in batches of 50-100 2-pad slides (i.e., 100-200 arrays). Two standard deviations above the average of the negative control intensity was used as a cut-off for detection of the tags. Overall, 3854 (96.4%) of the expressed proteins were positive for the HIS tag, 3730 (93.3%) were positive for the HA tag, 3538 (91%) were positive for both tags, and only 56 (1.4%) were negative for both tags, which means 98.6% of the expressed proteins were positive for at least 1 of the tags.

In more detail, purified minipreps of DNA of 4109 clones (3998 full length ORFs plus 111 segments of ORFs>3 kb) were expressed in the *E. coli* based in vitro transcription/translation expression system from Roche (RTS-100). 10 μl in vitro reactions were set up in sealed 384 well plates and incubated for 5 h at 30° C. in a platform microshaker at 300 RPM. A mixture of Tween-20 to a final concentration of 0.05% and a protease inhibitor cocktail (Cømplete, Roche) were then added. To minimize delay in printing after completion of protein expression, the initiation of the RTS reactions was staggered. The RTS reactions were printed in singlicate without further purification onto 2-pad nitrocellulose-coated FAST slides (Whatman) using an Omni Grid 100 microarray printer (Genomic Solutions) in 4×4 sub-array format, with each subarray comprising 17×17 spots. Each sub-array included 6 negative control spots comprising 'mock' RTS reactions lacking DNA template. Each sub-array also included positive control spots of 5 serial dilutions of mouse, rat and human whole IgG. Together these positive and negative controls are used to normalize the data from different arrays (infra). Also included were 4 serial dilutions of purified recombinant Epstein-Barr virus nuclear antigen-1 (EBNA-1) which is recognized by the majority of humans and which serves as a useful guide to serum quality. Also printed were three recombinant *M. tuberculosis* proteins, 38 KDa (Rv0934), CFP-10 (Rv3874 (SEQ ID NO:547)), and ESAT-6 (Rv3875 (SEQ ID NO:548)). In addition, 6 serial dilutions of recombinant vascular endothelial growth factor (VEGF) from Invitrogen (Carlsbad Calif.) and tumor necrosis factor-α (TNF-α) were printed to be used as a hybridization controls by 'spiking-in' monoclonal anti-VEGF and anti-TNF-α antibodies into certain sera samples.

For probing with sera, the sera were diluted to 1/200 in Low Cross Dilution Buffer (Candor Bioscience) containing *E. coli* lysate at a final concentration of 4-5 mg/ml protein, and incubated at room temperature for 30 minutes with constant mixing to block anti-*E. coli* antibodies. The arrays were rehydrated in blocking buffer (Candor Bioscience) for 30 min and probed with the pretreated sera overnight at 4° C. with constant agitation. The slides were then washed 5× in tris(hydroxymethyl)aminomethane (Tris)-buffered saline containing 0.05% (v/v) Tween 20, (T-TBS) and incubated in biotinylated anti-human IgG-Fc (Jackson Immuno Research) diluted 1/400 in dilution buffer. After washing the slides three times each in T-TBS, bound antibodies were visualized by incubation with streptavidin-conjugated SureLight® P-3 (Columbia Biosciences). The slides were then washed three times each in T-TBS followed by TBS, and dipped in distilled water prior to air drying by brief centrifugation. Protein expression was monitored on the printed array by probing with monoclonal anti-polyhistidine (clone His-1, Sigma) and anti-hemagglutinin (clone 3F10, Roche) using biotinylated anti-mouse and anti-rat secondary antibodies, respectively followed by streptavidin-conjugated SureLight® P-3.

Human sera: Sera were obtained from 927 patients enrolled from clinical sites in several TB-endemic areas of the world using a cohort design that included individuals presenting with respiratory symptoms suggestive of TB (TB suspects). Diagnosis of active TB was made on the basis of evidence of growth of *M. tuberculosis* from sputum of patients (culture-confirmed active TB) (n=403). Diagnosis of non-TB disease was made on the basis of full microbiological and chest X ray (CXR) investigations (n=418). Non-TB disease cases included were those not treated empirically for TB and who received adequate follow-up by symptom screen, and CXR at times, to exclude TB. BCG vaccination status was not always known, but cohorts were all from countries that implement universal BCG vaccination at birth. For data analysis, active TB cases were subdivided in smear positive TB (presence of *M. tuberculosis* in sputum) and smear negative active TB. Cases in the TB and non-TB disease group were also subdivided based on HIV comorbidity. Negative control sera (n=42) were obtained from healthy, asymptomatic individuals from a non-endemic country (Italy) who were confirmed latent TB infection (LTBI)-negative by tuberculin skin test, Quantiferon assay and tuberculosis ELISPOT (T-spot) assay. The BCG vaccination status of this latter set of donors is not known, but generally, individuals from endemic countries are vaccinated and those from non-endemic countries are not.

Data acquisition: Slides were scanned using a GenePix Autoloader 4200AL microarray confocal laser scanner (Molecular Devices) Median pixel intensity of the spots were quantified from tiff image files of probed array scans using GenePix Pro 6.0 software (Molecular Devices).

Classification of immunoreactive antigens by proteomic features and function: Antigens were classified according to the Functional Classification Codes annotated on TubercuList, Computational predictions were also made using SignalP (J Mol Biol 340(4): 783-795) and PSORTb (Bioinformatics 21(5): 617-623) (http://db.psort.org) to predict the presence probability of signal peptides and cellular localization, respectively.

Screening the proteome for serodiagnostic antigens: Representative arrays probed with serum from each group are shown in FIGS. 1A and 1B. Here, panel (A) shows culture-confirmed TB-positive individual, and panel (B) shows latent TB infected-negative control individual. Each array contained positive and negative control spots. The IgG control spots, which control for secondary antibody, were positive in both arrays. Neither individuals reacted with the negative ('no DNA') control reactions. Both groups of individuals reacted to EBNA-1, indicating prior exposure to EBV, and the group of acute infected individuals, had a robust antibody response to several *M. tuberculosis* antigens.

One evaluation of the array was performed by calculating a cut-off value above the mean+2 SD of the control ('no DNA') signals. By this criterion it was noted that sera from both TB-positive and control individuals reacted to antigens on the array. Even by visual estimation, however, it was evident that TB-confirmed patients reacted more intensely and against more antigens than the controls. To determine whether the signals seen for *M. tuberculosis* antigens were *E. coli*-specific antibodies against which blocking had failed, *E. coli* lysate concentration was increased. However, this had no effect on these signals (data not shown). Lysate prepared from *M. tuberculosis* was also included with the result that this completely abolished all signals on the array (data not shown), which indicates that the signals seen on the array are due to *M. tuberculosis*-specific antibodies in the sera.

Protein Microarray Data Analysis:

Microarray data were analyzed by four methods, summarized below. Log 10-transformed data were used for first three methods and VSN-normalized data were used for the fourth method. FIG. 4A shows proteins ranking<10 in at least one of three analytical methods (random forests, CERNO, and random forests with CERNO-prefiltered data) in a comparison between TB cases (n=400) and non-TB disease cases (n=418). Relative ranks of proteins (max rank ~4000) in each method are shown. N/A, not available; this implies that the protein was pre-filtered by CERNO (p value for filtration>0.005). FIG. 4B shows the same as FIG. 4A, but for a comparison between TB cases (n=255) and non-TB disease cases (n=307) among HIV negative persons only.

1. TB and non-TB samples were classified by Random Forests, a classification method based on multiple classification trees. Random forests queries (comparisons of TB to non-TB disease classes) were performed with data collected from sera from endemic countries, and with data stratified for HIV status and for smear status of TB patients. Antigens were ranked from most informative to least informative based on mean decrease accuracy output of a particular query (highest mean decrease accuracy corresponds to highest rank). The random forests analysis was conducted with and without a pre-filtering step using the CERNO statistical calculation.

2. CERNO p-values provide an association of high relative intensities with active tuberculosis diagnosis. Antigens were ranked by decreasing p-value.

3. The data were also analyzed to identify antigens that exhibit unusually high binding in TB samples relative to the non-TB disease samples by the following, sequential calculations: (i) the mean and variance for each antigen in non-TB from endemic areas; (ii) a Z score (number of standard deviations from the mean for an antigen in the non-TB disease class) for each antigen in each sample in one comparison (TB vs non-TB disease from endemic countries); (iii) a p-value corresponding to the Z score (expected normal distribution tail area above the value); (iv) the adjusted p-values (Benjamini-Hochberg) for each profile; (v) reactivity vs no reactivity at the p-adjusted level of 0.01 (false discovery rate of one percent). Antigens were ranked by number of reactivity calls in the TB group.

4. To stabilize variance of the raw data, a variant of the log-transformation (asinh) was used (Bioinformatics 20(5): 660-667), and negative and positive control spots (the 'no DNA' and IgG spots, respectively) were used to normalize the data using the "VSN" package in R from the Bioconductor suite (http://Bioconductor.org/). A p-value on the normalized data was prepared by comparing signals between the confirmed TB-positive and LTBI-negative control groups using a Bayes-regularized t-test adapted from Cyber-T for use with protein arrays (Bioinformatics 17(6): 509-519; J Biol Chem 276(23): 19937-19944; Bioinformatics 22(14): 1760-1766; Bioinformatics 23(13): i508-518). To account for multiple test conditions, Benjamini Hochberg p-value adjustments were calculated. Reactive antigens were defined as serodiagnostic or cross-reactive by having a Benjamini Hochberg corrected p-value <0.05 or >0.05, respectively, and an average signal intensity >2 std. dev above the mean of the negative control (no DNA) spots on the smear positive samples. Multiple antigen classifiers were built using Support Vector Machines (SVMs). The "e1071" and "ROCR" packages in R were utilized to train the SVMs and to produce receiver operating characteristic (ROC) curves, respectively. For other graphic representations such as heat maps and histograms, normalized data were retransformed into approximate raw values.

With the methods above, a total of 250 antigens were selected by combining top 50 ranks from Random Forests (RF) and CERNO for queries on all TB and non-TB disease patients, all HIV negative TB and non-TB disease patients (with and without stratification by smear), plus top 10 ranks for HIV-positive TB and non-TB disease query, plus reactivity calls of >3 in TB category, plus Benjamini Hochberg adjusted Cyber T p value<0.05. Seven sets of antigens were prioritized based on agreement by the methods, with the antigens of the first set being the most preferred.

The most preferred sequences encoding the antigens were characterized by RF or CERNO (p<0.005) plus reactivity calls, RF (<10) and CERNO (p<0.005), and Benjamini Hochberg adjusted Cyber T p value<0.05: Rv0798c (SEQ ID NO:121), Rv1886c (SEQ ID NO:270), Rv2031c (SEQ ID NO:284), Rv3616c (SEQ ID NO:509), Rv3804c (SEQ ID NO:534), Rv3874 (SEQ ID NO:547).

The following sequences producing the antigens were determined to be second most preferential, characterized by RF or CERNO (p<0.005) plus reactivity calls, RF (<10) and CERNO (p<0.005): Rv0302 (SEQ ID NO:52), Rv0379 (SEQ ID NO:65), Rv0394c (SEQ ID NO:66), Rv0456c (SEQ ID NO:74), Rv0632c (SEQ ID NO:103), Rv0944 (SEQ ID NO:142), Rv0984 (SEQ ID NO:146), Rv1030 (SEQ ID NO:153), Rv1196 (SEQ ID NO:174), Rv1242 (SEQ ID NO:180), Rv1284 (SEQ ID NO:187), Rv1387 (SEQ ID NO:206), Rv1837c (SEQ ID NO:264), Rv1926c (SEQ ID NO:275), Rv1980c (SEQ ID NO:281), Rv2094c (SEQ ID NO:294), Rv2544 (SEQ ID NO:363), Rv2618 (SEQ ID NO:375), Rv2746c (SEQ ID NO:391), Rv2870c (SEQ ID NO:407), Rv2873 (SEQ ID NO:408), Rv2875 (SEQ ID NO:409), Rv3050c (SEQ ID NO:434), Rv3248c (SEQ ID NO:458), Rv3376 (SEQ ID NO:478), Rv3763 (SEQ ID NO:527), Rv3810 (SEQ ID NO:536), Rv3864 (SEQ ID NO:545).

The following sequences producing the antigens were determined to be third most preferential, characterized by Benjamini Hochberg adjusted Cyber T p value<0.05: Rv2252 (SEQ ID NO:323), Rv2282c (SEQ ID NO:569), Rv0212c (SEQ ID NO:557), Rv3243c (SEQ ID NO:456), Rv3675 (SEQ ID NO:519), Rv2984 (SEQ ID NO:423), Rv1175c (SEQ ID NO:169), Rv3326 (SEQ ID NO:578), Rv3628 (SEQ ID NO:513), Rv3775 (SEQ ID NO:584), Rv3362c (SEQ ID NO:475), Rv0801 (SEQ ID NO:122), Rv1629 (SEQ ID NO:566), Rv0272c (SEQ ID NO:558), Rv3762c (SEQ ID NO:583), Rv3319 (SEQ ID NO:577), Rv3495c (SEQ ID NO:581), Rv2151c (SEQ ID NO:308).

The following sequences producing the antigens were determined to be fourth most preferential, characterized by reactivity calls: Rv0227c (SEQ ID NO:37), Rv0280 (SEQ ID NO:50), Rv0993 (SEQ ID NO:148), Rv1306 (SEQ ID NO:192), Rv1363c (SEQ ID NO:204), Rv2050 (SEQ ID NO:288), Rv2116 (SEQ ID NO:299), Rv3417c (SEQ ID NO:486), Rv3653 (SEQ ID NO:516).

The following sequences producing the antigens were determined to be fifth most preferential, characterized by ranks<10 by either CERNO or RF: Rv1253 (SEQ ID NO:182), Rv3413c (SEQ ID NO:485), Rv1635c (SEQ ID NO:232), Rv3021c (SEQ ID NO:432), Rv1193 (SEQ ID NO:173), Rv2592c (SEQ ID NO:369), Rv3620c (SEQ ID NO:510), Rv0929 (SEQ ID NO:139), Rv0959 (SEQ ID NO:145), Rv1162 (SEQ ID NO:166), Rv2389c (SEQ ID NO:341), Rv2984 (SEQ ID NO:423), Rv2588c (SEQ ID NO:367), Rv0171 (SEQ ID NO:26), Rv1865c (SEQ ID NO:267), Rv2074 (SEQ ID NO:290).

The following sequences producing the antigens were determined to be sixth most preferential, characterized by ranks<25 by either CERNO or RF: Rv0543c (SEQ ID NO:87), Rv1677 (SEQ ID NO:237), Rv1304 (SEQ ID NO:191), Rv2841c (SEQ ID NO:400), Rv3680 (SEQ ID NO:520), Rv0831c (SEQ ID NO:125), Rv2032 (SEQ ID NO:285), Rv3127 (SEQ ID NO:446), Rv3272 (SEQ ID NO:464), Rv3323c (SEQ ID NO:470), Rv3508 (SEQ ID NO:494), Rv3628 (SEQ ID NO:513), Rv1173 (SEQ ID NO:167), Rv2623 (SEQ ID NO:376), Rv0527 (SEQ ID NO:85), Rv1620c (SEQ ID NO:229), Rv1901 (SEQ ID NO:272), Rv2151c (SEQ ID NO:308), Rv0362 (SEQ ID NO:60), Rv3129 (SEQ ID NO:447), Rv3140 (SEQ ID NO:449), Rv0340 (SEQ ID NO:56), Rv2792c (SEQ ID NO:395), Rv3003c (SEQ ID NO:426), Rv3019c (SEQ ID NO:431), Rv3862c (SEQ ID NO:544), Rv0572c (SEQ ID NO:91), Rv2477c (SEQ ID NO:356), Rv2659c (SEQ ID NO:379), Rv0311 (SEQ ID NO:54), Rv0350 (SEQ ID NO:57), Rv2127 (SEQ ID NO:301), Rv3875 (SEQ ID NO:548), Rv0877 (SEQ ID NO:134), Rv1916 (SEQ ID NO:274), Rv2138 (SEQ ID NO:303), Rv2847c (SEQ ID NO:403), Rv3118 (SEQ ID NO:444), Rv2495c (SEQ ID NO:358), Rv3669 (SEQ ID NO:517), Rv0281 (SEQ ID NO:51), Rv2711 (SEQ ID NO:383), Rv2744c (SEQ ID NO:390), Rv3803c (SEQ ID NO:533), Rv1239c (SEQ ID NO:179), Rv2147c (SEQ ID NO:307), Rv2253 (SEQ ID NO:324), Rv0308 (SEQ ID NO:53), Rv0587 (SEQ ID NO:95), Rv1564c (SEQ ID NO:224), Rv2185c (SEQ ID NO:313).

The following sequences producing the antigens were determined to be seventh most preferential, characterized by ranks between 26 and 50 by either CERNO or RF: Rv1805c (SEQ ID NO:261), Rv2729c (SEQ ID NO:386), Rv3386 (SEQ ID NO:481), Rv3515c (SEQ ID NO:497), Rv0772 (SEQ ID NO:116), Rv2948c (SEQ ID NO:420), Rv0006 (SEQ ID NO:1), Rv1906c (SEQ ID NO:273), Rv2244 (SEQ ID NO:322), Rv2468c (SEQ ID NO:354), Rv3701c (SEQ ID NO:522), Rv0054 (SEQ ID NO:6), Rv1945 (SEQ ID NO:277), Rv3345c (SEQ ID NO:472), Rv0276 (SEQ ID NO:48), Rv0709 (SEQ ID NO:108), Rv1527c (SEQ ID NO:220), Rv2048c (SEQ ID NO:287), Rv2414c (SEQ ID NO:345), Rv3524 (SEQ ID NO:499), Rv3556c (SEQ ID NO:502), Rv1322 (SEQ ID NO:196), Rv2934 (SEQ ID NO:417), Rv0270 (SEQ ID NO:47), Rv0612 (SEQ ID NO:99), Rv1699 (SEQ ID NO:242), Rv2728c (SEQ ID NO:385), Rv3017c (SEQ ID NO:430), Rv3364c (SEQ ID NO:476), Rv3418c (SEQ ID NO:487), Rv3718c (SEQ ID NO:525), Rv0426c (SEQ ID NO:70), Rv1181 (SEQ ID NO:171), Rv1725c (SEQ ID NO:250), Rv0256c (SEQ ID NO:44), Rv0605 (SEQ ID NO:98), Rv0737 (SEQ ID NO:114), Rv0834c (SEQ ID NO:126), Rv1255c (SEQ ID NO:184), Rv2224c (SEQ ID NO:320), Rv1843c (SEQ ID NO:265), Rv2333c (SEQ ID NO:334), Rv2490c (SEQ ID NO:357), Rv3183 (SEQ ID NO:454), Rv0668 (SEQ ID NO:106), Rv1556 (SEQ ID NO:223), Rv1673c (SEQ ID NO:236), Rv3513c (SEQ ID NO:496), Rv3675 (SEQ ID NO:519), Rv3870 (SEQ ID NO:546), Rv3891c (SEQ ID NO:552), Rv0163 (SEQ ID NO:24), Rv0710 (SEQ ID NO:109), Rv1297 (SEQ ID NO:189), Rv1745c (SEQ ID NO:255), Rv0600c (SEQ ID NO:97), Rv1536 (SEQ ID NO:222), Rv1738 (SEQ ID NO:254), Rv2524c (SEQ ID NO:359), Rv3086 (SEQ ID NO:440), Rv3367 (SEQ ID NO:477), Rv0135c (SEQ ID NO:20), Rv0627 (SEQ ID NO:101), Rv1448c (SEQ ID NO:213), Rv3224a (SEQ ID NO:455), Rv0029 (SEQ ID NO:2), Rv0846c (SEQ ID NO:129), Rv1159 (SEQ ID NO:165), Rv1186c (SEQ ID NO:172), Rv1705c (SEQ ID NO:243), Rv1713 (SEQ ID NO:248), Rv2476c (SEQ ID NO:355), Rv3402c (SEQ ID NO:483), Rv2615c (SEQ ID NO:374), Rv2995c (SEQ ID NO:425), Rv3788 (SEQ ID NO:585), Rv0140 (SEQ ID NO:555), Rv0203 (SEQ ID NO:33), Rv1531 (SEQ ID NO:565), Rv1693 (SEQ ID NO:241), Rv1882c (SEQ ID NO:269), Rv2143 (SEQ ID NO:568), Rv2367c (SEQ ID NO:570), Rv0584 (SEQ ID NO:94), Rv1651c (SEQ ID NO:567), Rv3197a (SEQ ID NO:576), Rv3369 (SEQ ID NO:579), Rv3825c (SEQ ID NO:586), Rv0101 (SEQ ID NO:15), Rv0808 (SEQ ID NO:123), Rv0814c (SEQ ID NO:560), Rv2153c (SEQ ID NO:309), Rv2933 (SEQ ID NO:416), Rv0071 (SEQ ID NO:9), Rv2471 (SEQ ID NO:571), Rv2979c (SEQ ID NO:575), Rv0155 (SEQ ID NO:556), Rv0581 (SEQ ID NO:559), Rv2631 (SEQ ID NO:377), Rv3455c (SEQ ID NO:489), Rv3601c (SEQ ID NO:505), Rv0896 (SEQ ID NO:562), Rv1641 (SEQ ID NO:234), Rv3005c (SEQ ID NO:427), Rv3759c (SEQ ID NO:582), Rv3800c (SEQ ID NO:532), Rv0187 (SEQ ID NO:30), Rv2379c (SEQ ID NO:338), Rv2434c (SEQ ID NO:352), Rv2940c (SEQ ID NO:574), Rv3477 (SEQ ID NO:580), Rv0435c (SEQ ID NO:72), Rv0844c (SEQ ID NO:128), Rv0856 (SEQ ID NO:561), Rv1191 (SEQ ID NO:564), Rv2803 (SEQ ID NO:397), Rv0783c (SEQ ID NO:118), Rv1054 (SEQ ID NO:563), Rv1689 (SEQ ID NO:240), Rv2539c (SEQ ID NO:572), Rv2859c (SEQ ID NO:573), Rv3777 (SEQ ID NO:528).

Figure 2A:
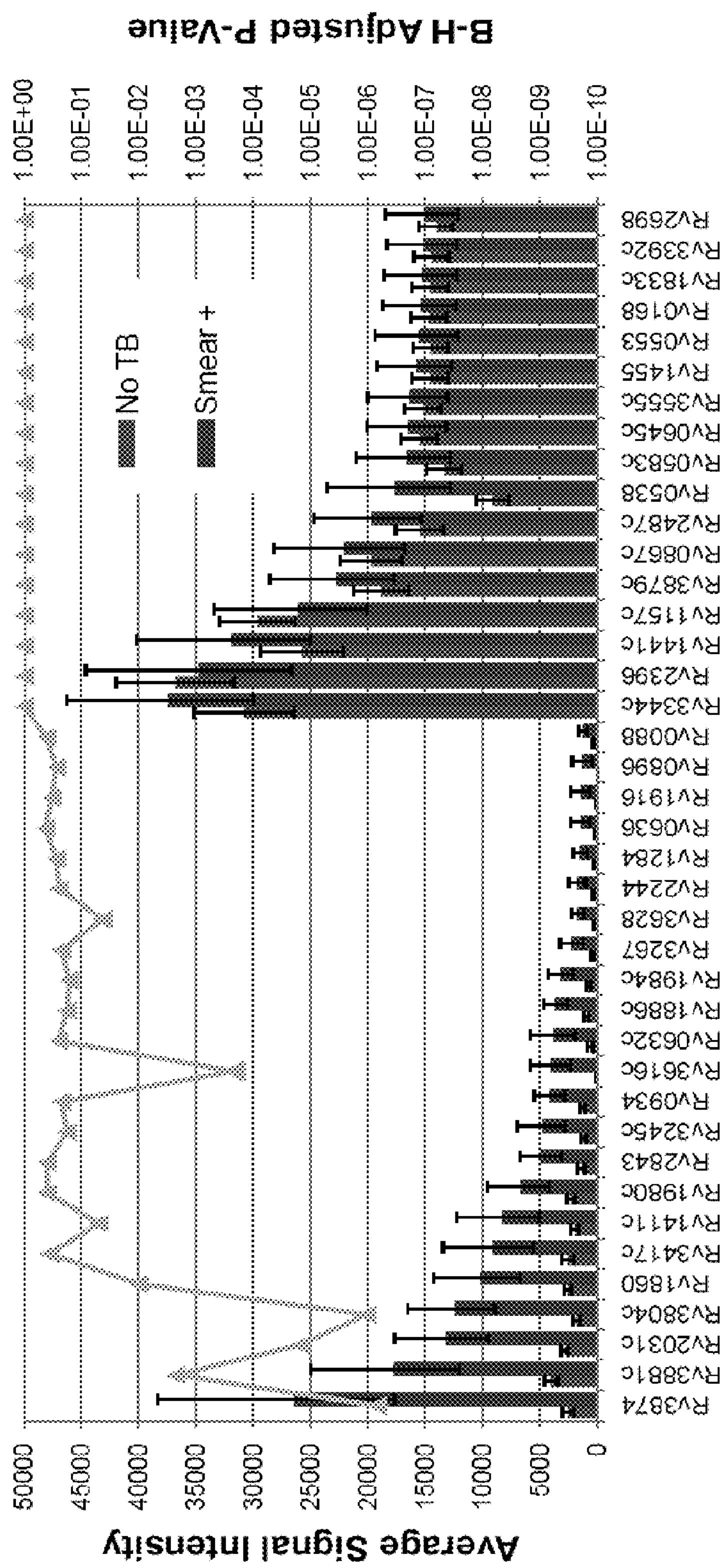
FIGS. 2A and 2B are graphs depicting exemplary statistical representations in differences in signals for TB-positive and LTBI-negative results.

In additional methods, to identify serodiagnostic antigens, t-tests for each reactive antigen were performed comparing normalized signal intensities of TB-cases to controls, and exemplary results are shown in FIG. 2A. Here, Cyber T-tests revealed signals for 23 antigens as significantly different between the smear-positive TB cases (n=13) and the LTBI-negative controls (n=69). These antigens are shown in the histogram by the average of their normalized signal intensities for the two patient groups, and ranked in descending order of the signals in the smear-positive group. The p-value for each antigen is also shown (top), arranged so that the more significant antigens produce downward pointing spikes.

Figure 2B:
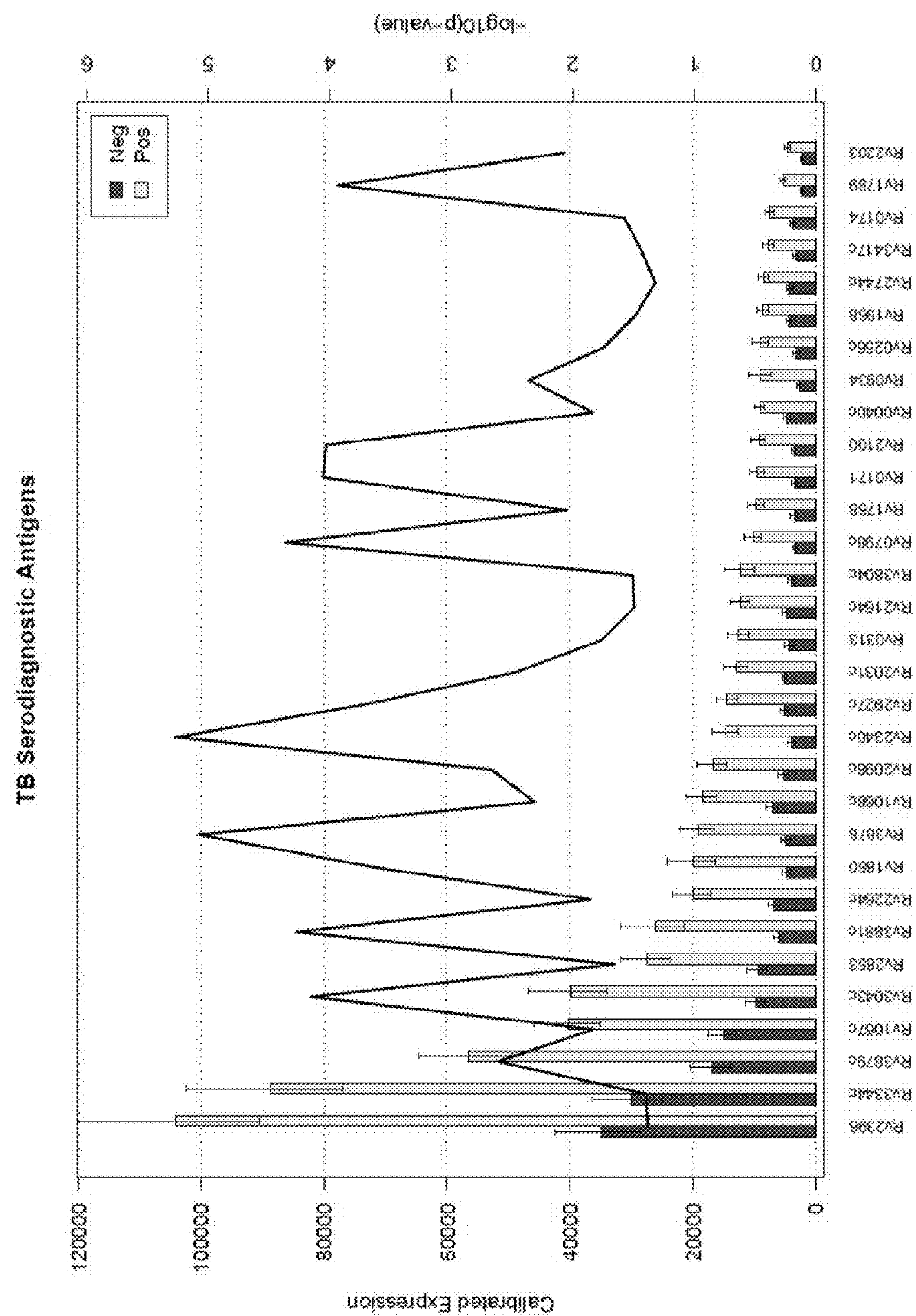

Based on probing sera from 48 LTBI-negative subjects and 50 TB culture positive subjects, a total of 31 antigens were found to discriminate between these groups and were considered serodiagnostic as depicted in FIG. 2B. It was further found that combining multiple antigens produces a test with increased specificity and sensitivity. The top 2 discriminatory antigens have an AUC of >0.88, and the addition of another 3 antigens to the classifier improves the AUC score to >0.90. Using 10 antigens gives an AUC score of >0.93. Remarkably, further addition of antigens does not improve the AUC score of the classifier. For the sera in this study the top 10 discriminatory antigens yields a sensitivity of >80% identification of true negatives and a sensitivity of >90% for finding the true positives. These results clearly support the ability of whole proteome chips using ORFeomes created using enzymeless recombination cloning, and proteomes expressed using *E. coli* based cell free expression systems, as valid tools for serodiagnostic antigen discovery. These classifiers will benefit from a larger, more comprehensive profiling study of well characterized serum samples.

The inventors then studied the diagnostic power of different numbers of ORFs using receiver operating characteristic (ROC) curves. A ROC curve is a parametric plot of the false positive rate (1-specificity) vs. the true positive rate (sensitivity) of a classifier as the underlying discrimination threshold is varied. The area under the curve (AUC) summarizes the results. An AUC of 1.0 indicates a perfect classifier, while an AUC of 0.51 (95% confidence interval, 0.43 to 0.59) is the expected value for a classifier that works by chance for the data set, as inferred by the method of Truchon and Bayly (J Chem Inf Model 47(2): 488-508). For multiple antigens, kernel methods and support vector machines were used (Bioinformatics: the Machine Learning Approach, Second Edition edn.: MIT Press) to build linear and nonlinear classifiers. As input to the classifier, the highest-ranking 1, 2, 5, 10, and 30, ORFs were used on the basis of either p-value or single antigen AUC and the results were validated with 10 runs of threefold cross-validation. The results (data not shown) showed that increasing the antigen number from 1 to 5, and from 5 to 10 produced an incremental improvement in the classifier. Increasing numbers beyond this did not improve the algorithm's ability to discriminate the two populations. Contingency tables built on these data showed that using 10 antigens at an optimal threshold provides an accuracy of 94% of the true positives and 78% of the true negatives.

Alternatively, antigen selection was also performed as follows: Raw data were distributed into the two groups of the query and subsets were normalized using vsn on the control spots. A CyberT test was run on the normalized data, and SVM classifier was built with a subset of the top antigens. Duplicates were removed. Each sample included meta data that was used to build each of the 10 queries, and each group was a disjoint subset of the original data, and each query only had two groups. Data were normalized using arsinh normalization (Bioinformatics, 18 Suppl 1, 2002), which compensates for variance dependence on mean. An affine-linear transformation (scale all value+add a value) was performed on each sample to compensate for shifts between samples, thus allowing a t-test on the normalized data. The CyberT test was used to estimate the variance of a spot by using neighboring spots (Bioinformatics, 17(6):509-519, 2001), giving a statistical measure of the difference in means between two groups for a particular antigen. Subsetting the p-values: Antigens are subset based on the significance of the p-value. Multiple test correction is used, and antigens are subset on the Bonferroni or the Benjamini-Hochberg p-value (<0.05) in most cases. Building a (SVM) classifier: Classifiers were built using a number of the top antigens to provide an estimate of what classification accuracy we could be obtained for each query. This allows for determination of the optimal number of antigens to be included in the final classifier. 3-fold cross-validation was used and ROC plots were generated to visualize the results. A list of exemplary results using this analysis is provided in the list of serodiagnostic antigens shown in FIG. 2C.

Enrichment analysis: To determine the features of proteins that were enriched in the immunodominant antigen set, proteins were classified into one of 11 functional categories according to the TubercuList genome database (http://genolist.pasteur.fr/TubercuList/). The number of 'hits' for each category was determined in the immunodominant antigen set. 7 immunodominant antigens were considered serodiagnostic, of which 4 (57.1%) were proteins with proline-glutamic (PE/PPE) motifs. Since the whole proteome contains 168 (4.2%) PE/PPE motif proteins, this represents a significant 13.6-fold enrichment relative to the whole proteome. Importantly, none of the 167 'cross-reactive' immunodominant antigens were significantly enriched in any of the functional categories. The number of serodiagnostic antigens could be increased to 31 if all antigens were assessed regardless of immunodominance. Of these, 6 (19.4%) were virulence factors and 10 (32.2%) were PE/PPE motif proteins, representing a significant 7.7-fold enrichment for both, relative to the whole proteome.

Interestingly, molecules involved in intermediary metabolism were significantly underrepresented (0.1-fold enrichment) in the serodiagnostic set relative to the whole proteome.

Several computational predictions were also made to classify the antigens. Lipoproteins and cell wall proteins were not enriched in the serodiagnostic antigen set, whereas possession of a signal sequence or an extracellular classification by PSORTb were enriching. High coil content, high glycine and high proline were all enriching features. PE/PPE molecules, characterized as having highly conserved proline rich motifs 100-200 amino acids long with high coil content near the N-terminus, were significant enriching features. Twenty-six out of 31 molecules in the serodiagnostic antigen set were negatively charged with isoelectric point<6.7. Again, none of these predicted features were enriched in the cross reactive antigen set.

Figure 3:
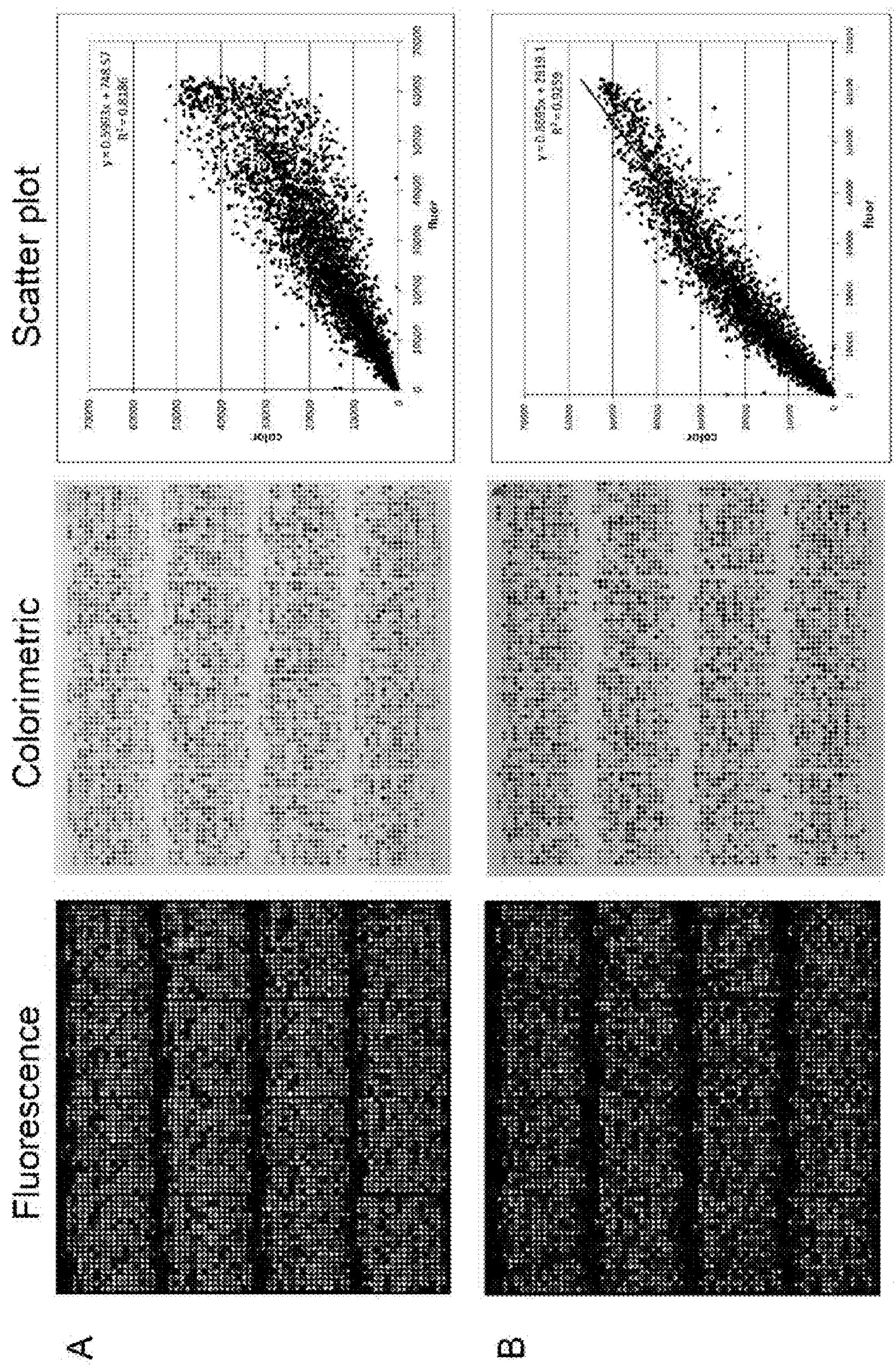
FIGS. 3A and 3B depict exemplary fluorimetric and calorimetric visualization of exemplary microarrays and respective scatter plots indicating the correlation between the visualizations.

Comparison of fluorescence and calorimetric detection of bound antibodies: The ability to replace fluorescence detection with a calorimetric methodology would assist in wider deployment of the arrays where fluorescence scanners would be impractical or where a smaller device would be preferable, such as in high containment laboratories or routine diagnostic laboratories. However, it was not known whether a calorimetric readout would have a reduced sensitivity or dynamic range compared to fluorescence. With this aim the HIS and HA tag-specific monoclonal antibodies were visualized with appropriate alkaline phosphatase-conjugated secondary antibodies and the arrays were developed with nitro-TB developer. Grey scale 2400 dpi resolution TIFF images were obtained using a conventional desktop document scanner and scatter plots of the 4608 data points compared with fluorescent detection. The correlation for signals for the HIS and HA tags were high (r2=0.8186 and 0.9259, respectively). Fluorescence based detection gave 99.2%, 97.0%, 96.6% and 0.4% for poly-His tag detection, HA tag detection, both tag detection and no tag detection, respectively. Colorimetric based detection gave 93.7%, 88.6%, 84.8% and 2.5% for poly-His tag detection, HA tag detection, both tag detection and no tag detection respectively. While fluorescence based detection is somewhat more sensitive (since there were fewer 'double negatives'), alkaline phosphatase based detection is a comparable alternative that can be performed with only basic equipment. FIG. 3 depicts representative scans of arrays proved with antibodies to (A) HIS and (B) HA tag antibodies and visualized by fluorescence and calorimetric means; scatter plots are of calorimetric vs. fluorescence data.

Further illustrative exemplary methods and protocols are provided in the parent application PCT/US07/23299 (published as WO2008/140478), which is incorporated by reference herein.

Thus, specific embodiments and applications of compositions and methods related to antigens of *M. tuberculosis* have been disclosed. It should be apparent, however, to those skilled in the art that many more modifications besides those already described are possible without departing from the inventive concepts herein. The inventive subject matter, therefore, is not to be restricted except in the spirit of the appended claims. Moreover, in interpreting both the specification and the claims, all terms should be interpreted in the broadest possible manner consistent with the context. In particular, the terms "comprises" and "comprising" should be interpreted as referring to elements, components, or steps in a non-exclusive manner, indicating that the referenced elements, components, or steps may be present, or utilized, or combined with other elements, components, or steps that are not expressly referenced. Furthermore, where a definition or use of a term in a reference, which is incorporated by reference herein is inconsistent or contrary to the definition of that term provided herein, the definition of that term provided herein applies and the definition of that term in the reference does not apply.

Sequence Listing

The Sequence Listing providing sequences with the SEQ ID NO:1 to SEQ ID NO:586 is submitted as a single file on a single compact disc in computer readable format, wherein the single file is entitled "101519.0003US1 Sequence listing_ST25.txt", which was created May 8, 2009, which has a size of 948 kb, and which is incorporated by reference herein.

SEQUENCE LISTING (586 sequences)

SEQ ID NO: 1 - DNA, 2517 bp, Mycobacterium Tuberculosis
atgacagacacgacgttgccgcctgacgactcgctcgaccggatcgaaccggttgacatcgagcaggagatgcagcgcagctacatcgactatgcgatgagcgtgatcgtcggccgcgcgctgccggaggtgcgcgacgggctcaagcccgtgcatcgccgggtgctctatgcaatgttcgattccggcttccgcccggaccgcagccacgccaagtcggcccggtcggttgccgagaccatgggcaactaccacccgcacggcgacgcgtcgatctacgacagcctggtgcgcatggcccagccctggtcgctgcgctacccgctggtggacggccagggcaacttcggctcgccaggcaatgacccaccggcggcgatgaggtacaccgaagcccggctgaccccgttggcgatggagatgctgagggaaatcgacgaggagacagtcgatttcatccctaactacgacggccgggtgcaagagccgacggtgctacccagccggttccccaacctgctggccaacgggtcaggcggcatcgcggtcggcatggcaaccaatatcccgccgcacaacctgcgtgagctggccgacgcggtgttctgggcgctggagaatcacgacgccgacgaagaggagaccctggccgcggtcatggggcgggttaaaggcccggacttcccgaccgccggactgatcgtcggatcccagggcaccgctgatgcctacaaaactggccgcggctccattcgaatgcgcggagttgttgaggtagaagaggattcccgcggtcgtacctcgctggtgatcaccgagttgccgtatcaggtcaaccacgacaacttcatcacttcgatcgccgaacaggtccgagacggcaagctggccggcatttccaacattgaggaccagtctagcgatcgggtcggtttacgcatcgtcatcgagatcaagcgcgatgcggtggccaaggtggtgatcaataacctttacaagcacacccagctgcagaccagctttggcgccaacatgctagcgatcgtcgacggggtgccgcgcacgctgcggctggaccagctgatccgctattacgttgaccaccaactcgacgtcattgtgcggcgcaccacctaccggctgcgcaaggcaaacgagcgagcccacattctgcgcggcctggttaaagcgctcgacgcgctggacgaggtcattgcactgatccgggcgtcggagaccgtcgatatcgcccgggccggactgatcgagctgctcgacatcgacgagatccaggcccaggcaatcctggacatgcagttgcggcgcctggccgcactggaacgccagcgcatcatcgacgacctggccaaaatcgaggccgagatcgccgatctggaagacatcctggcaaaacccgagcggcagcgtgggatcgtgcgcgacgaactcgccgaaatcgtggacaggcacggcgacgaccggcgtacccggatcatcgcggccgacggagacgtcagcgacgaggatttgatcgcccgcgaggacgtcgttgtcactatcaccgaaacgggatacgccaagcgcaccaagaccgatctgtatcgcagccagaaacgcggcggcaagggcgtgcagggtgcggggttgaagcaggacgacatcgtcgcgcacttcttcgtgtgctccacccacgatttgatcctgttcttcaccacccagggacgggtttatcgggccaaggcctacgacttgcccgaggcctcccggacggcgcgcgggcagcacgtggccaacctgttagccttccagcccgaggaacgcatcgcccaggtcatccagattcgcggctacaccgacgccccgtacctggtgctggccactcgcaacgggctggtgaaaaagtccaagctgaccgacttcgactccaatcgctcgggcggaatcgtggcggtcaacctgcgcgacaacgacgagctggtcggtgcggtgctgtgttcggccggcgacgacctgctgctggtctcggccaacgggcagtccatcaggttctcggcgaccgacgaggcgctgcggccaatgggtcgtgccacctcgggtgtgcagggcatgcggttcaatatcgacgaccggctgctgtcgctgaacgtcgtgcgtgaaggcacctatctgctggtggcgacgtcagggggctatgcgaaacgtaccgcgatcgaggaatacccggtacagggccgcggcggtaaaggtgtgctgacggtcatgtacgaccgccggcgcggcaggttggttggggcgttgattgtcgacgacgacagcgagctgtatgccgtcacttccggcggtggcgtgatccgcaccgcggcacgccaggttcgcaaggcgggacggcagaccaagggtgttcggttgatgaatctgggcgagggcgacacactgttggccatcgcgcgcaacgccgaagaaagtggcgacgataatgccgtggacgccaacggcgcagaccagacgggcaattaa

SEQ ID NO: 2 - DNA, 1098 bp, Mycobacterium Tuberculosis
gtggcgatcttcggtcgatggagtgcgcgccagcgactccggagagcgacccgggaatccctcacgattccgacgtttagctcctcgctggattgcaccacacgggtaattggcgggctctggcccgctgagctttcgtctaacaccgccgaaaccgccacgcttgcagaacatctgaaagcggatctgcatcggatagttggttctgccaacgacgagctgatggtcatctggcgtgcggggatggctgattcgacgcgacgcgcagaagaagacagagtgatcgaccgcgcccgcgcgtcggcgatgcgtcgcgtcgagtcggcgatgcgcgagcttcggcagataacggggcgcgttcccgtggaaattccgcgtatgcgcggcgccggcggctcggatctggacacgacacgactcatgccggccgtcacggtagttcagcccgctgaccaggcctgtacggattggccggttgccgccgccgaggatgacgaagcccgactgcagcgcctcctggcgttcgtggctcgtcaggagccacggctgaactgggcggtcggcgttcacgcggacggcacgacggtcctggtcaccgacgtcgcccatggttggatacctccgggcatcgcccttcccgaaggcgtgcgattgttggcaccggcgcgacgcgccggcagagcccccgagttggtcggtatcacgacgtgttgcaagacgtacacccccggtgactcgctgcgtcgggcggtcgattcaaccgcgccgacgtcctcggtgcagccgcgagcgttgccagcgatcgccggcctgagtgtggagctgggcatagcgacccagcggcacgacggcttaccgaagatcgtgcacgccatggccacggcggccggcaacggcgccgccgccgaggaagtcgacctgttgcgggtgcacgtcgataccgcgctccaccacgtcttggcccagtatccccgggtcgatccggcgttactgctcaactgtatgttgttggccgccaccgagcgcagcgtcacgggagacccgatcgcggcgaactatcacttcgcgtggttccgggaactcgattcacgccgatag

SEQ ID NO: 3 - DNA, 213 bp, Mycobacterium Tuberculosis
ttgctggcaaggcatttcggcgcggggcgcaaggcccacagccgggccgtggccaccctgaaagccgatatccaagcctggcacccggctggcatccagaccccgaagccgcgatgcgaatcagatgtgttcgcgcgaatcggtcacacgagccacccatcaactcggaagagccgggtggggccgggagcatccgaggcaccgcttgcctga

SEQ ID NO: 4 - DNA, 1689 bp, Mycobacterium Tuberculosis
atgacggcggccttgctttcaccagccatcgcctggcagcagatctcggcttgcacggaccgcacgctgacgatcacttgcgaggattccgaggtaatcagctatcaggacctcatcgcgcgcgcggcggcatgcatccccccgctacggcgtcttgacctcaaacgcggtgaacccgtgctgatcaccgcccacaccaacctggaattcctgtcctgctttttgggcctcatgctccatggcgctgtgccggtacccatcccgccgcgggaggcactgaagaccaccgagcgtttcatgactcggctcggcccactgctgcgccatcaccgcgtgctgatctgcacaccggccgaacacgacgagatacgcgctgccgccagcaccgactgccagatcagcagatttactgccctagccgaggctggcgacgagcagttcggccgcgccacggcccagcaactcgccgacaccgccaccgccgactggccgctatgcaccctcgacgacgacgcctacgtccaatacacctctggcagcaccgcagcaccacgcggagtggtcatcacctaccgcaacctgctgtccaacatgcgcgcaatggccgtgggctcacaattccagcacggcgatgtcatgggcagctggctgcccttgcaccatgacatggggctggtgggcagcctattcgccgcactcttcaacagtgtcagcgcggtattcaccacgccacaccggtttctgtatgacccgttgggattcctcagactgctcaccagctccggggctacccacacgttcatgcctaacttcgctctggagtggctgatcaacgcctaccacaggcgcggcgccgacatcgaaggcatcgacctacacaaaatgcgccgcttgatcatcgcctccgaacccgtccatgccgagggcatgcggagattcgccgccaccttcgccggcgtcggacttgcccccacggccctgggttcgggctatggcctggccgaagcgaccgtcgccgtgtcgatgtcagcgcccaacacgggattccgcaccgaaacccacgccgccgcggaggtcgtcaccggcggccgagtgctgcctggctacgaggtgcgcattgacgccgcaccaggtgcccgggccggaacgatcaaactgcgcggcgacagcgtggccgccaaagcctatgtgggcgggaagaagctggacgcgctcgacgaggaaggcttctgcgacacccacgacttgggttttcttgtagacgacgaaatcgtcatccttggccggcaggacgaggtgttcattgtccacggagaaaacagattcccctacgacatcgagttcatcattcgcggggaatccgagcagcaccggaccaaagtcgcatgtttcggggtcaacgaacgcgtcgtggttgtgttggaaagcccattggacagcatcatcgacaaggccgaagccgaccgactgagatgtcaagtcgttgccgcgactgggctgcagttggatgaactgatcacggttcggcgcggcgcgattcccaccaccaccagcggcaagctcaaacgacgcgccgtcgcgcaggcttatcgagacggcacactgccccgtcttgccacccacgcgtggacggcggatcccgatagcgctcccaaaacgacccggtccagcctggaaggcgcccactga

SEQ ID NO: 5 - DNA, 933 bp, Mycobacterium Tuberculosis
atgatccagatcgcgcgcacctggcgggtcttcgcaggcggcatggccaccggtttcatcggcgtggtgctggtcaccgccgggaaggcctcagcggatcccctgctgccaccgccgcctatccctgccccagtctcggcgccggcaacagtcccgcccgtgcagaacctcacggcgcttccgggcgggagcagcaacaggttctcaccggcgccagcacccgcaccgatcgcgtcgccgattccggtcggagcacccgggtccaccgctgtgcccccgctgccgccgccagtgactcccgcgatcagcggcacacttcgggaccacctccgggagaagggcgtcaagctggaggcacagcgaccgcacggattcaaggcgctcgacatcacactgcccatgccgccgcgctggactcaggtgcccgaccccaacgtgcccgacgcgttcgtggtgatcgccgaccggttgggcaacagcgtctacacgtcgaatgcgcagctggtggtgtataggctgatcggtgacttcgatcccgctgaggccatcacacacggctacattgacagccagaaattgctcgcatggcagaccacaaacgcctcgatggccaatttcgacggctttccgtcatcaatcatcgagggcacctaccgcgaaaacgacatgaccctcaacacctcccggcgccacgtcatcgccacctccggagccgacaagtacctggtttcgctgtcggtgaccaccgcgctgtcgcaggcggtcaccgacgggccggccaccgatgcgattgtcaacggattccaagtggttgcgcatgcggcgcccgctcaggcgcctgccccggcacccggttcggcaccggtgggactacccgggcaggcgcctgggtatccgcccgcgggcaccctgacaccagtcccgccgcgctag

SEQ ID NO: 6 - DNA, 495 bp, Mycobacterium Tuberculosis
gtggctggtgacaccaccatcaccatcgtcggaaatctgaccgctgaccccgagctgcggttcaccccgtccggtgcggccgtggcgaatttcaccgtggcgtcaacgccccggatctatgaccgtcagaccggcgaatggaaagacggcgaagcgctgttcctccggtgcaatatctggcgggaggcggccgagaacgtggccgagagcctcacccggggggcacgagtcatcgttagcgggcggcttaagcagcggtcgtttgaaacccgtgagggcgagaagcgcaccgtcatcgaggtcgaggtcgatgagattgggccttcgcttcggtacgccaccgccaaggtcaacaaggccagccgcagcggcgggtttggcagcggatcccgtccggcgccggcgcagaccagcagcgcctcgggagatgacccgtggggcagcgcaccggcgtcgggttcgttcggcggcggcgatgacgaaccgccattctga

SEQ ID NO: 7 - DNA, 2625 bp, Mycobacterium Tuberculosis
atggcggtcgttgatgacctagcgcccggcatggactcctcaccgcccagtgaagattacggccgtcaaccaccgcaggatctcgccgccgagcagtccgtgctgggcgggatgttgctgagcaaggacgccatcgccgatgtactggaacggctacggcccggcgatttttatcgtccggcgcatcagaacgtctacgacgccattttggacctgtatgggcggggagaaccggctgatgcggtgacggtggccgccgaactggatcgccgtgggctgctgcgccgcatcggcggtgctccctacctgcacaccctgatctcgacggtgccgacggccgccaacgcgggctactacgcgagcatcgttgccgaaaaggcgctgctgcgccggctggtagaggccggaacccgggtggtgcagtacggctatgccggcgccgaaggcgcggatgtggccgaggtggtcgatcgcgcgcaggccgaaatctacgacgtcgcggatcggcggctgtcggaagactttgtggcgcttgaggacctgctgcaaccgacgatggacgagatcgatgccatcgcttccagtggcggcctggcgcgcggggtggctaccggcttcaccgaactcgacgaggtcaccaacggcctgcatccggggcagatggtcatcgtggcggcgcgcccgggcgtgggaaagtccacccttgggctggacttcatgcggtcatgctcgatcaggcatcggatggccagcgtcatcttctcgctggagatgagcaagtccgagattgtcatgcgactgctgtcggcggaggccaaaatcaagctctccgacatgcgttcgggccggatgagcgatgacgactggacccggctggcgcggcggatgagcgaaatcagcgaagcgccactgtttatcgacgactcgcccaacctgaccatgatggagatccgtgccaaggcgcgccgcctgcggcaaaaggccaacctgaagttgatcgtggtcgactacctgcaactgatgacctcgggcaagaagtatgaatcacggcaggtggaggtgtcggagttctcgcggcatctgaagctgttggcaaaagagcttgaggttcccgtggtcgcgatcagccagctcaaccgtgggcccgagcagcgtaccgataagaaaccgatgctggccgacctcagggaatcgggctgcctgaccgcgtccaccagaatcttgcgcgccgataccggcgctgaggtcgccttcggtgagctcatgcgaagcggtgaacgtcccatggtgtggtcgctggacgagcggctgcgcatggtggcccggccgatgatcaacgtgttcccgagcgggcgcaaggaagtgtttcggcttcggctggcttccggacgcgaagtcgaggccaccggcagccacccctttatgaagttcgaaggctggactcccttggcgcagttgaaggttggtgaccggatcgcagcaccgcgccgggtacctgagcccatcgacactcagcggatgcccgagtctgagctcatttcgctggctcgcatgatcggtgacgggtcgtgcctgaagaaccagccgatccgctacgagccggtggatgaggcgaacctggccgcggtgacggtctcggcggcgcactcggatagggctgcgatccgcgacgactacctcgcagctcgagtgccgtcgttgcgcccggcgcggcaacgactaccgcgcgggcggtgcacgccgattgcggcgtggctggctggcctagggctattcacgaaacgcagccacgaaaaatgcgtaccggaggctgtatttcgcgcccccaatgaccaggtggcgttgtttctgcggcatctgtggagcgctggtggctctgttcggtgggatcccacgaatggtcaaggccgggtctactacggctcaaccagtaggcgtctcatcgacgatgtggctcaattgctgcttcgggttgggattttttcctggatcacacacgccccaaagttgggcggccacgattcgtggcggctgcacattcatggcgcgaaggatcaggtcaggttccttcgtcacgtcggcgttcacggcgccgaagcggtggcggcccaagagatgctgcgtcagctcaaaggaccggttcgcaacccgaacctggacagcgcgccgaaaaaagtatgggcgcaagtccgcaaccgactgtccgccaaacagatgatggacatccagctccacgaaccgacgatgtggaagcattccccgagccggtcaaggccgcatcgcgcggaggcgcggatcgaagatcgagcgatccatgagctggcgagaggcgacgcgtactgggacaccgtcgtggagatcaccagcattggagatcaacatgttttcgatgggactgtaagcggcacacacaatttcgtcgccaatggcattagtttgcacaattcgctggaacaagatgccgacgttgtcatcctgctgcatcgacccgacgcctttgaccgcgacgatccacgtgggggagaagcggatttcattctcgccaaacaccgcaacggtccgacgaagacggtcaccgtagcgcatcaactgcacctgtcacgcttcgccaacatggctcggtga

SEQ ID NO: 8 - DNA, 2238 bp, Mycobacterium Tuberculosis
atgagcgccgaacagccgaccatcatttacacgctgaccgacgaggcgccgctgctggcgacctacgcctttctgccgattgtgcgtgcctttgccgaaccggcgggcatcaagatcgaggccagcgacatctctgtagcggcacgcatcctggcggaattccccgattacctgaccgaggagcagcgggtaccggataacctcgccgaactgggccggctgactcagctacccgacaccaacatcatcaagctgccgaacatcagcgcctcggtgccacagctggtagccgccatcaaggaactgcaagacaagggttacgcggtcccagactacccggcggacccgaagactgaccaggagaaggccatcaaagagcgctacgccagatgcctgggcagcgcggtgaacccggtactgcgccaaggcaattcggaccgtcgggcgcccaaggcggtgaaggagtacgcgcgcaagcacccgcacagcatgggcgagtggtcgatggcctcacgcacccacgtagcgcacatgcggcacggtgacttctacgccggcgagaagtcgatgacactggaccgcgcgcgcaacgtgaggatggaactgctggccaagagcggcaagacgatcgtgctcaagcccgaggtgccgctggatgacggcgacgtcatcgacagcatgttcatgagcaagaaagcgctgtgcgacttctacgaagagcagatgcaggatgcgttcgagaccggcgtgatgttctccttgcacgtcaaggcgaccatgatgaaggtcagccaccccatcgtcttcggccacgcggtcaggatcttctacaaggacgccttcgccaagcaccaggagctgttcgacgacttgggcgtcaacgtcaacaatggcttgtccgatctgtacagcaagatcgagtcgctgccggcgtcgcaacgcgacgagatcatcgaggacctacaccgttgccacgaacaccgccccgagctcgcgatggtcgattcggccagaggtatctccaacttccactcgccgagcgatgtgatcgtggacgcctcgatgcccgcgatgattcgcgcgggcggcaagatgtatggcgccgacggaaagctcaaggacaccaaggcggtcaacccggagtccaccttctcgcgcatctatcaggagatcatcaacttctgcaagacaaatggccagttcgatccgacgacgatgggcaccgtccccaatgtgggtctgatggcccagcaggccgaggagtacggctcgcacgacaagacgttcgagattcccgaggacggcgtcgccaacatcgtcgatgtcgccaccggcgaggtgctgctgaccgagaacgtggaagccggcgacatctggcgcatgtgcatcgtcaaggacgcaccgatccgtgactgggtcaagctggctgtcacccgcgcgcgcatctccgggatgccggtgctgttctggctggacccgtaccgcccgcacgagaacgagctgatcaagaaggtcaagacatacctgaaagatcacgacaccgaaggtctggacatccagatcatgtcgcaagtgcgatccatgcgctacacgtgcgagcgcctggtccgtggactggacaccatcgccgcgaccggcaacatcctgcgcgactacctcaccgacctgttcccgatcctggagttaggcaccagcgccaagatgctgtccgtcgttccgctgatggccggcggcggaatgtacgagacgggggcgggcggttcggcacccaagcacgtcaaacaattggtggaggagaatcacctgcgctgggattctctgggtgagttcctcgcgctgggcgccggtttcgaggatatcggcatcaagaccggtaacgagcgggccaaactcttgggtaagaccctggatgccgccatcggcaagctgctggacaacgacaagagtccgtcgcgcaaaaccggtgaactcgacaaccggggcagccagttctacctcgccatgtactgggcacaagagctggccgcgcagaccgacgaccagcagctggccgaacacttcgcctcgctggcagatgtgttgaccaaaaacgaagacgtcatcgtgcgagagctcaccgaggtacaaggcgaaccggtggacatcggcggctactacgcgccggacagcgacatgactacggcggtgatgcggcccagcaagacgttcaatgcagcgctggaggctgtccaaggctga

SEQ ID NO: 9 - DNA, 708 bp, Mycobacterium Tuberculosis
atgagttcgatcacggtgtcggtggacccggtggacccggtggacccggtggacccggtggacccggtggacgccgtggtcgccgcgggatcagacgggctcactgtggcccgcatcgagtccgagatcggggccttggagttcctgaacgaactgcgcactgaactcaagagtggacagtttcgacctcaaccggtgcgggaacgcaagatccccaaaccgggcgggttgggcaaggtacggcggctggggattcccacagtggccgaccgggtcgttcaggcggcgttgaaactggtgctagaacccatctttgagaccgacttcgagccggtctcctacgggtttcggcccgcgcgacgcgcgcacgacacgatcgctgagattcacttgttcggcacccaggagtatcgctgggtgctcgacgctgatatcaaggcgtgctttgaccgcatcgaccacgcggacctgatggaccgggtgcgtcaccggatcaaagacaagcgggtgttgcggctggtgaactggcagcgcattcggcatcgctggaattggaccgacgtccgccgctggctcaccgaccccaccgggcggtggcaccccatcagcgcggacgggatcaccctgtttaaccccgccgcggtgcccattcggcgataccgctatcggggcaacacgatccccactccctggactcaggctgtctga

SEQ ID NO: 10 - DNA, 1050 bp, Mycobacterium Tuberculosis
atgctcttcgcggccctgcgtgacatgcaatggagaaagcgccgcctggtcatcacgatcatcagcaccgggctgatcttcgggatgacgcttgttttgaccggactcgcgaacggcttccgggtggaggcccggcacaccgtcgattccatgggtgtcgatgtattcgtcgtcagatccggcgctgctggaccttttctgggttcaataccgtttcccgatgttgacctggcccgagtggccgctgaacccggtgtcatggccgcggccccgttgggcagcgtggggacgatcatgaaagaaggcacgtcgacgcgaaacgtcacggtcttcggcgcgcccgagcacggacctggcatgccacgggtctcagagggtcggtcaccgtcgaaaccggacgaagtcgcggcatcgagcacgatgggccgacacctcggtgacactgtcgaggtcggcgcgcgcagattgcgggtcgttggcattgtgccgaattccaccgcgctggccaagatccccaatgtcttcctcacgaccgagggcttacagaaattggcgtacaacgggcagccgaatatcacgtccatcgggatcataggtatgccccgacagctgccggagggttaccagactttcgatcgggtgggcgctgtcaatgatttggtgcgcccattgaaggtcgcagtgaattcgatctcgatcgtggctgttttgctgtggattgtggcggtgctgatcgtcggctcggtggtgtacctttcggctcttgagcggctacgtgacttcgcggtgttcaaggcgattggcacgccaacgcgctcgattatggccgggctcgcattacaggcgctggtcattgcgttgcttgcggcggtggtgggcgtcgtcctggcgcaggtgttggcaccactgtttccgatgattgtcgcggtacccgtcggtgcttacctggcgctaccggtggccgcgatcgtcatcggtctgttcgctagtgttgccggattgaagcgcgtggtgacggtcgatcccgcgcaggcgttcggaggtccctag

SEQ ID NO: 11 - DNA, 1236 bp, Mycobacterium Tuberculosis
atgggcgatctgagcattagccaggtgtcggcgcgtccgggacggatcgggattcgcgctaggcaaatgttcgacggataccggtttcagcgtggtcccgtgctggtcgtggtcgaggatggtcggatcagcgcggtcgattttgctggctccgcctgccccgatatgaacctggttgatctgggtgaatcgactttgttgccgggtctggtggatgcgcatgcgcatttgtgctgggaccccgacggtaggccagaggatttggccggcgacccccatgcggtgctggtgggacgggcgcgacggcacgccgcggccgcgttgcgctccgggatcaccacgattcgcgatctcggcgaccgtgactatgcggccttggcgctgcgggaggagtatcggcagaaaacgacggtggggccggaactggtggtttctgggccaccattgactcgcagcggcgggcattgctggttcctcggcggcgtggccgatagcgtcgaggagctggttgatgcggtgcaggagcgggccgcgcggggagcggattggatcaaggtgatggccacgggcggattcgttaccacagcatccgatccgtggcagccgcagtacggcagcggccaactggccgcggtggtggcggccgccgagcaggtaggtctaccggtgaccgcacatgcacatgccaccgcagggatcgccgcggcggtcgccgcgggtgttgacggcatcgagcactgcacgttcttgagcgaaggcagcgccgccgccagcccggatgttgttgaagcgattgttgcccaaggtgtgtggtgcggtatgacgattccccgggtgtatccggagatgccggagaaccttgtcgcggttgtgcaggatggatggcgaaacatccgccggctcatcgacgccggtgcgcgtgtcgccctgtccaccgacgctggagtcgccccgggcagacgccatgacgtgctccccgacgatttggtgtatctgtctcgacacgggttcaccagcacagaggtgctgaccggcgccaccgcagcggccgctgccagctgtgggctcggccaccgcaagggtcgcatcgcgccgggctacgacgctgatctgctggctgttgcggcaggtgtggaccatgaccccgccggactctgcgacgtcaaagccgtctggcgcagcggaacccaggtaccgctacaagcatccgctgtgggctacaacaccccgtcataa

SEQ ID NO: 12 - DNA, 1173 bp, Mycobacterium Tuberculosis
atgcaggacagcatcttcaatctgttgaccgaggaacagcttcggggtcgcaacacgctcaagtggaactatttcgggcccgatgtagtgccactgtggctggcggagatggactttcccaccgcaccggctgtgctcgacggggtgcgggcgtgcgtcgacaacgaggagttcggctacccgccgttgggcgaggacagcctgccgagggcgacggccgattggtgccgacaacgctacggttggtgcccccgaccggactgggtccgcgtcgtgccggatgtcctgaaggggatggaagtcgtcgtcgaattccttacccggccggagagtccggtcgcgttgccggttccggcttacatgccgtttttcgacgtcctgcacgtcaccggccgccaacgagtggaagtcccaatggtgcagcaagactcgggacgctacctgctggacctggacgctctgcaggccgcgttcgtccgcggtgccggatcggtgattatctgcaatccgaataacccactgggtacggcgttcaccgaagccgagctacgtgcgattgtggatatcgcggcccgccacggcgcccgggtgatcgcggatgagatctgggcaccggtggtctacggatcgcgccatgtcgccgccgcttcggtgtcggaggcggcggctgaagtcgtggtcacgttggtgtcggcgtccaaaggctggaacttgccgggtctgatgtgcgctcaggtgatcctgtctaaccgccgtgacgcccacgactgggaccggatcaacatgttgcaccgcatgggcgcatcaacggtcggtatccgcgcgaacatcgccgcctaccatcatggcgaatcttggttggacgagctgctcccttatctgcgggcgaaccgtgatcatctggcacgggcgctgccggagttagctcccggggtagaggtcaacgctccggacggtacctacctgtcgtgggtggatttccgtgcgctggctctgccgtctgaaccggcggaatacctgctctcgaaggcgaaggtggcgctgtcgcctggcattccgttcggcgccgcggtgggctcgggatttgcgcggctgaacttcgccaccacccgcgcaatactggatcgggcgatcgaggctatcgcggccgccctgcgcgacatcatcgattaa

SEQ ID NO: 13 - DNA, 1392 bp, Mycobacterium Tuberculosis
atggctataccaccggaggtgcactcgggcctgttgagcgccgggtgcggtccgggatcattgcttgttgccgcgcagcagtggcaagaacttagtgatcagtacgcactcgcatgcgccgagttgggccaattgttgggcgaggttcaggccagcagctggcagggaaccgccgccacccagtacgtggctgcccatggcccctatctggcctggcttgagcaaaccgcgatcaacagcgccgtcaccgccgcacagcacgtagcggctgccgctgcctactgcagcgccctggccgcgatgcccaccccagcagagctggccgccaaccacgccattcatggcgttctgatcgccaccaacttcttcgggatcaacaccgttccgatcgcgctcaacgaagccgattatgtccgcatgtggctgcaagccgccgacaccatggccgcctaccaggccgtcgccgatgcggccacggtggccgtaccgtccacccaaccggcgccaccgatccgcgcgcccggcggcgatgccgcagatacccggctagacgtattgagttcaattggtcagctcatccgggatatcttggatttcattgccaacccgtacaagtattttctggagtttttcgagcaattcggcttcagcccggccgtaacggtcgtccttgcccttgttgccctgcagctgtacgactttctttggtatccctattacgcctcgtacggcctgctcctgcttccgttcttcactcccaccttgagcgcgttgaccgccctaagcgcgctgatccatttgctgaacctgcccccggctggactgcttcctatcgccgcagcgctcggtcccggcgaccaatggggcgcaaacttggctgtggctgtcacgccggccacggcggccgtgcccggcggaagcccgcccaccagcaaccccgcgcccgccgctcccagctcgaactcggttggcagcgcttcggctgcacccggcatcagctatgccgtgcccggcctggcgccacccggggttagctctggccctaaagccggcaccaaatcacctgacaccgccgccgacacccttgcaaccgcgggcgcagcacgaccgggcctcgcccgagcccaccgaagaaagcgcagcgaaagcggcgtcgggatacgcggttaccgcgacgaatttttggacgcgaccgccacggtggacgccgctacggatgtgcccgctcccgccaacgcggctggcagtcaaggtgccggcactctcggctttgccggtaccgcaccgacaaccagcggcgccgcggccggaatggttcaactgtcgtcgcacagcacaagcactacagtcccgttgctgcccactacctggacaaccgacgccgaacaatga

SEQ ID NO: 14 - DNA, 237 bp, Mycobacterium Tuberculosis
gtgcgggaccgaatcctcgccgccgtctgcgacgtgttgtatatcgacgaggcggatctcattgatggcgacgaaacggatctccgcgacctcgggctggactctgttcggtttgttctgctgatgaagcagctaggcgtgaaccgacaatccgaactgccgtcccgattggccgcgaacccgtcgattgcgggttggcttcgcgagctggaggctgtgtgcaccgagttcggttaa

SEQ ID NO: 15 - DNA, 7539 bp, Mycobacterium Tuberculosis
gtgcaccgagttcggttaagccgctcgcagcgcaacctctacaacggcgtgcgccaggataacaatcccgcgttatatctgatcggcaagagctatcggttccgccggttggagctggcgagattcctggccgctctgcacgcaacggtactggacaaccccgtgcaactttgcgtcctggagaattcgggggcagactatccggatctggtgccgcggctacggttcggcgacatcgtgcgggtggggtcagccgatgagcacctgcagagcacatggtgttcgggcatcctgggcaagccactggtgcggcatacggtgcacaccgacccgaacgggtatgtgaccggtctggacgttcacacccaccacatcctgctggacggcggcgcgaccgggacgatcgaagctgacctggcgcgttacctgaccaccgacccggcgggcgaaacccccagtgtcggtgcgggtctagccaagctcagggaggcgcaccgtcgtgagacggccaaggtggaagaatcgcgggggcgcctgtcggctgtcgtgcagcgtgaactcgccgacgaagcataccacggcgggcacgggcacagcgttagcgacgctcccgggaccgcggccaagggcgtcctgcacgaatcggcaacgatctgcggcaacgcgtttgatgccatcctgaccctttcggaagcgcagcgggtcccgcttaatgtgctggtggctgcggcggccgtcgcggtggacgcgagccttcggcagaacaccgaaaccctcttggtgcacacggtggacaaccggttcggagattctgatctgaatgtcgcgacctgtttggtcaattcggttgcccagaccgtccggtttcccccatttgcgtcggtgtccgatgtcgttcgaacgcttgaccgcggctatgtcaaggcggtaagacgccggtggcttcgtgaggagcattaccgccgaatgtatttggcgatcaaccggacatctcacgtggaggcgttgacgctaaatttcattcgcgagccatgcgcacctggcctgcgcccgttcttgtcggaggtcccgattgccacggatatcggtccggtcgagggcatgacggtggcgtctgttctggacgaagaacagcgcacactgaacctagccatctggaaccgagccgatctgcccgcgtgcaagacacaccccaaggtcgcggaacggatagcggcagcgttggaatcgatggcggcgatgtgggatcggccgatcgccatgatcgtcaacgactggttcgggatcggcccggacgggactcgctgccaaggcgattggccagcccgtcagccgtcgacgcccgcgtggtttctcgattccgcaaggggcgtccaccaatttctcggcaggcgccgcttcgtctacccgtgggtcgcgtggttggtgcaacgcggcgccgcaccgggtgatgttctggtgttcaccgacgacgacaccgacaagaccattgacctgctcatcgcgtgtcaccttgcgggttgcgggtacagcgtctgcgacaccgctgacgaaatttccgtgcggaccaatgcgattaccgagcacggcgatggcatcttggtgacagtggtcgacgtggccgccacccagctggcggttgtcggccatgacgagctgcggaaggtcgttgacgagcgcgtcacacaggtgacacacgacgcactgctggccaccaagaccgcctacatcatgccgacctcgggaactaccggacaacccaagctggtgcgaatctcacacggctcgctcgcggttttctgtgatgcgatcagccgcgcctacggttggggagcccacgacaccgttctgcagtgcgctccgttgacatcggacatcagcgtcgaggagattttcggtggcgcggcctgtggcgcgcgactggtgcgatccgcggctatgaaaaccggcgacctggcggcgctggttgacgatctcgtcgcccgcgagacgacaatcgtcgacctgccgaccgccgtctggcagctgttgtgcgccgacggcgacgccattgacgcgatcggccgctcgcgcctgcggcagatcgtaatcggcggtgaagccatccgctgtagcgccgtggacaagtggcttgaatcggctgcttcacaagggatctcgctgctctcgagctatggtccaacagaagccacggtcgtcgccaccttcttgccgatcgtttgcgaccagaccaccatggacggcgcactgctcaggctcggccggccgatcctaccgaacacggtgttcctcgcgttcggtgaagtcgtcattgtcggggatttagtcgccgacggctacctcgggatcgacggcgacggcttcggcaccgtgacggccgcagacggttcccgacgccgtgcctttgccactggcgaccgggtgaccgtcgacgccgaaggatttccggtcttctccggacgcaaagacgccgtcgtcaagatctccggcaagcgtgtcgatatcgctgaggtaaccaggcgcatcgccgaagaccccgcggtgtcagatgtcgccgtcgagttgcacagcggaagcctcggagtgtggttcaagagccaacggacccgcgagggcgaacaagacgctgccgcggcgacccggatcaggctcgtcctcgtgagtctgggagtgtcgtcgtttttcgttgtcggcgtgccgaatatcccgaggaagcccaacgggaagatcgacagcgacaacctgccgaggctgcctcagtggtcagctgctgggctaaacaccgccgagacgggtcagcgagcggccggcctctcgcagatctggagccggcagctcggccgggcaatcgggccggactcgtcgctgcttggtgagggcatcggctcgttggatctcatcagaatactgcccgagacgcgtaggtatctggggtggcgcctctcgctgctggatctgatcggtgccgataccgccgccaatctggccgattacgcgccaacgcccgacgcgccgacgggcgaagatcggtttaggccgctggtggccgcgcaacggcccgcggcgattccgttgtcgtttgcccagcggcgactatggtttctcgaccagttacagcgacccgctccggtctacaacatggcggtggcgttgcggctgcgcgggtatctcgataccgaggcgttgggcgcggcggtcgccgatgtcgtgggccgccacgaaagcctacggacggtgtttccggcggtcgacggggtccctcggcagctggtcatcgaagcgcggcgggcagatcttggctgcgacatcgtcgatgccaccgcatggccggctgaccggctgcaacgggccatcgaggaggcggcgcgccacagcttcgatttggcaaccgagatacctttgcggacgtggcttttccggatcgccgacgacgaacatgtgctggtggcggttgcacaccatatcgccgccgacggctggtcggtggctccgctgacggccgatctgagtgcggcatatgccagccgttgtgcgggtcgggcaccggactgggcgccattgccagtgcagtatgtcgattacacgctgtggcagcgggaaatcctcggtgatctcgacgacagcgacagcccgatcgccgcgcagctggcctactgggaaaatgcgttggccggtatgccggaacggctgcggctgcccaccgctcggccctatccaccggttgccgatcagcgcggcgccagtttggtggtggattggccggcgtcggtgcaacagcaggtgcgtcggatcgcccgccagcacaacgcgaccagcttcatggtggtagctgccgggcttgccgtgctgctgtcgaaactcagcggaagccccgatgtggcggtcggatttcccatcgccggccgcagcgatcctgcgctggataacttggtgggcttttttgtcaacaccttggtgttgcgggtcaacctggccggtgatcccagcttcgccgaactgctggggcaggtgcgagcgcgcagcctggccgcctacgaaaatcaagacgtacctttcgaggtgctcgttgatcgcctcaaacccactcgagccctgacccatcacccgctgatccaggtgatgttggcctggcaggacaatccggttggacagctgaatttgggtgatctgcaggccaccccgatgccgatcgacacccgcaccgcccgcatggacttggtgttttcgttagcggaacgcttcagcgagggtagcgaacctgccgggatcggcggagcggtggaataccgcaccgatgtgtttgaagcccaagcaatcgacgtgcttatcgagcggttgcggaaggtgttggtggcggtggccgctgctccggaacggacggtgtcgtcgatcgatgcgctggatgggaccgagcgtgcccggttggatgagtggggtaaccgcgctgtgctgactgcgcccgcgcccacgccggtgtcgatcccgcagatgttggccgcccaggtggcacgtatccccgaagcggaggcggtgtgttgcggggacgcgtcgatgacgtatcgggaactcgacgaggcgtccaaccggttagcgcatcggctggcaggttgtggggccggcccgggcgagtgtgtggcgctgctgttcgagcggtgcgcgccggcggtcgtggcgatggtggcagtgctcaaaaccggggcggcgtatctgccgatcgatccggcgaatcctccgccgcgggtggcgttcatgctcggcgacgcggtgcccgtggccgcggtcaccacggctgggctgcgctcccggttggcgggacacgacttgccgatcatcgatgtcgtcgatgctttagcggcatatccgggcacgcccccacccatgccggccgcagtgaacctcgcctacatcctgtacacctcgggcactaccggcgagcccaaaggcgtggggatcacccatcgcaacgtcaccaggctgttcgcatcactgccggcacgcttgtcggcggcgcaggtgtggtcgcagtgtcattcctatggcttcgacgcctcggcgtgggagatctggggcgcgttgctaggtggtgggcgactggtgatcgtgcccgagtcggtggcggcctcgccgaacgactttcatgggctgctcgtggccgaacacgtcagcgtgctgactcagactccggctgcggtggcaatgttgccgacgcagggtttggagtcggtggcgttggtggtggccggtgaggcatgtccggcagcgctggtggatcggtgggcgcccgggcgggtgatgctaaatgcttatggcccaaccgagaccacgatctgtgcggcgataagtgcgccgttgcgaccgggttcggggatgccgccgattggtgttccggtgtcgggggcggcgttgtttgtgctggatagctggttgcgcccggtaccggccggggtggccggagagttgtacattgccggtgcgggcgtcggtgttgggtattggcgtcgggcggggctgaccgcgtcacggtttgtggcctgcccattcggcggttccggggcacgcatgtatcgcaccggggatctggtgtgttggcgcgccgatggccagttggagttcctggggcgcaccgacgatcaggtcaagatccgcgggtatcgcatcgagctcggcgaggttgcgaccgcgctggccgagctggctggggtaggtcaagcggttgtaatcgcccgtgaagaccgccctggggacaagcgcctagtcgggtatgccaccgaaattgcccccggggcagtggacccggccgggctgcgggcgcaactagcccagcgattgcccggttacctggtgccagccgcggtggtagtgatcgatgcgcttccgttgacggtcaacggcaaacttgatcatcgtgcgttgccggcaccggaatacggtgataccaacggatatcgcgctccggccgggccggttgagaagaccgtggccggcatctttgcccgggttcttgggcttgagcgggtcggcgtcgacgactcgttcttcgagctcggcggcgattcgctggcggcaatgcgggttatcgccgcgatcaacaccaccctaaacgccgatctgccggtgcgcgcgttgctgcacgcgtcgtcgacgagaggtttaagccagctgttggggcgagatgcccgaccgaccagcgatccgcgcttggtgtctgtgcacggcgacaaccccaccgaggtgcatgccagcgacctcacgctggaccggttcatcgacgccgacacgctggccaccgccgtcaacctgccgggcccgagccccgagctacggacggtcctgctgacgggcgcgacgggtttcctcggacggtatctggtccttgaattgctgcggcggctggacgtcgacggcaggctgatctgtttggtgcgggcggagtccgacgaggatgcgcggcgtcgtctggagaagaccttcgatagcggtgacccggaattgctgcggcacttcaaggagcttgccgccgaccggctggaggtcgtcgcaggcgacaagagcgaacccgacctgggcctggaccaaccgatgtggcggcggctggccgaaaccgtggatttgattgtcgattccgcggcgatggtcaacgcgtttccctaccacgaattgttcgggcccaacgtcgcgggcaccgccgagctgatccgaatcgcgcttaccaccaagctcaaacccttcacctacgtgtcaaccgccgacgtgggtgctgcgatcgagccgtcggcgttcaccgaggacgccgacatccgggtaatcagccccacccgcaccgtcgacggcggctgggctggcggctacggcaccagcaagtgggccggtgaggtgctgctgcgcgaggccaacgacctgtgcgcgctgccggtcgcggtgtttcgctgcgggatgatcctggccgacaccagctatgccggacagctcaacatgtcggactgggtcacccggatggtgttgagcttgatggctaccggcatcgcgcctcgttcgttctacgaaccggactccgagggcaatcggcaacgcgcgcacttcgacgggctgccagtcaccttcgttgccgaggcgatcgcggtgctgggcgcgcgggtggccggctcatcgttggcgggatttgcgacctatcacgtgatgaacccgcacgacgacggtatcgggctcgatgagtatgtggactggctgattgaggccggctacccgatacgccgcatcgatgactttgcggagtggttgcagcggtttgaggccagcctgggcgctctgccggatcggcaacgccggcactcggtgctgccgatgctgctggcgagcaattcccagcgattgcagccgcttaagccgaccagggggtgctccgcgccgaccgaccgattccgtgccgcggtgcgagcggcgaaagtcggctccgacaaggacaatccagacatcccgcacgtgtcggcgccgaccatcatcaactacgtcaccaacctacaactgctcggactgctgtag

SEQ ID NO: 16 - DNA, 4899 bp, Mycobacterium Tuberculosis
gtgaagatcccgggtgtggccactgtcctcggtggtgtgaccaacggagtagcacagacagtgcgagccggcgcccgcttgccggggagtgcggccgcggcggtgcagacgctggccagcccggtgctggagctgaccggcccggtggtgcagtcggtggtgcaaacgactggtcgcgcaatcggggtacgcggttcccacaacgaatcgcctgacggaatgacaccgccggtgcgttggcgcagcggacggcgcgtgcatttcgacctggatccgctactgccattccctcgctggcacgagcatgccgccatggtggaggagccagtccgcaggatcccgggcgtggccgaggcccacgttgagggctcattgggtcggctggtggtcgaacttgaacctgatgcggatagcgacatcgccgtggacgaggtacgtgatgtggtttccgcggtggctgccgacatattcctggctgggtcggtgtcgtcgccgaactcggcaccattcgccgacccaggtaaccccttggcgatcctggtgccgttgaccgctgcggcaatggatctggtagcgatgggtgccacggtcaccggctgggtcgcccgactgcccgccgcaccgcaaaccaccagagccctggccgctctgataaaccatcaaccgcgaatggtgtcgcttatggagtcgcggttgggtcgagtgggcaccgatattgcgctcgccgctacgacggcggcggccaacgggctaacccagtccctgggcacaccgctgctcgatctggtgcaacgcagcctgcaaatctccgaagcggcggcgcaccgtcgcgtatggcgtgaccgcgaacccgcgctggcctcccccagacggccgcaggctccggtggtgcccatcatctcgtcggccggggccaaatcgcaggagccgcgacacagttgggcggctgcggcggcaggcgaggcttcgcacgtcgtggtcggcggatccatcgacgccgcgatcgacaccgccaaagggtcaagggccgggccggtggagcaatacgtcaaccaggccgcaaacggttcgttgatcgccgcggccagtgcactggtggccggcggtggtaccgaggacgcggccggcgcgatcctggccggagtaccacgtgccgcgcacatgggccgacaggcgttcgcggcggtgctgggtcgcgggctcgccaacaccgggcaactagtcctcgaccccggcgcgttgcgccgcctggatcgggtgcgggtggtcgttatcgacggcgcagcgctgcgcggtgacaaccgcgccgtattgcatgcacagggagacgaacccggctgggacgacgaccgcgtctacgaggtcgccgacgccttgctccatggcgagcaggcacccgaacccgaccccgatgaattgccggctaccggtgcccgcttgagatgggctccggctcaagggccgtcggcaacgccggctcagggcctcgagcatgccgacctggtggtcgatggccaatgcgtgggcagcgtcgacgtggggtgggaagtcgacccatacgcaatcccgctgctgcagaccgcgcaccgaaccggagcgcgggtggttttgcgccatgtcgcgggcaccgaagatctatcggccagcgtcggttcgacgcatccgcctggcacgccgttgctgaagttggtgcgtgagttgcgcgcggatcgcggaccggtattgctgatcaccgcggtgcaccgggacttcgcatccaccgatacgttggccgcgttggccatcgctgacgtcggtgtggctctcgacgatccccgcggggcaacaccatggactgccgacctaatcaccggcaccgatctggccgcggcggtgcggatcctgtcagcgcttccggtggcccgggcagccagtgaatccgcggtacacctcgcccaaggtggcaccaccttggccgggctgttgttggtcaccggtgagcaggacaaaaccaccaacccagccagcttccgtcgctggctcaatccggtcaatgccgctgccgcaacggctttggtgtccggaatgtggtcggccgccaaggtgctgcggatgcccgaccccaccccgcaaccgctgaccgcctggcacgcgctggaccccgagatcgtctactcgcggctagccggcggctcccgacccttggccgtcgaacccggaatcccggcctggcggcgcattctggacgacctgtcctacgaaccggtgatggcgccgctgcgcggcccggcacgaaccttggcgcagctggcggtggccacccgccatgaactggccgatccgctgactccgatcctggcggtgggcgccgcagcatcggcgattgtcggcagcaatatcgacgcgctactggtagcgggcgtgatgacggtcaacgcgatcaccggtggggtacaacgattgcgagccgaggcggcggccgccgagctattcgccgagcaggaccagctggtgcgccgggtggtggtgccggcggtagcgactacccgacgtcgactggaggcggcccggcacgccacccggacggccacggtgtcggcgaagtcgctgcgagtcggcgatgtcatcgacctggccgcgccggaggtggtcccggcggatgcgcgcctgctggtggccgaagacctcgaggtcgacgagtcctttcttaccggcgagtcgctaccggtggacaagcaggtggaccccgtcgccgtcaacgaccccgaccgggccagcatgctgtttgagggcagcaccatcgtcgccggacacgcccgcgcgatcgtggtagccaccggagtcggcaccgccgcacatcgcgcgatctcggcggtcgccgatgtcgaaacggcggccggagtccaggcccggctgcgcgagctgaccagcaaagtgctgcccatgacgttggccggcggcgccgcggtgacagctctggcgttgctgcgccgggcgtcgctgcggcaagcggtggccgacggcgtcgccatcgcggtggccgcggtcccggagggtctaccgttggtggccaccctctcccagcttgccgccgcccagcgcctgacggcacgtggggcgctggtgcgctcgcctcgcaccatcgaggcgctgggccgtgtcgacaccatatgtttcgacaagaccggcacactcaccgagaaccgcctgcgggtggtatgcgcgctaccgagcagcaccgcagccgaacgggatccgttgccgcagaccaccgatgcgccctccgccgaggtgctgcgggccgccgcgcgcgcgtccacgcagccccataacggggaagggcacgcgcacgccaccgatgaggcgatcctcgcggcggctagtgcgctggccggttcgcttagtagccaaggcgattcggagtgggtggtgctggccgaagtaccgtttgagtccagtcgcggctacgccgccgcgatcggcagagtgggcaccgacgggataccgatgttgatgctcaagggcgctccggagacgatcctgccgcgctgccgactcgccgacccgggcgtcgaccacgaacatgccgaatccgtggtacgccacctcgccgagcagggcctgcgtgttctggcagtcgcgcagcgcacctgggacaacgggaccacccatgatgacgagaccgacgccgacgctgtcgacgccgtcgcgcacgatctcgagctgatcggctatgtcggattggcggatacggcccggtcttcctcgcgtccgttgatcgaagccttgctggacgccgagcgcaacgtggtgctgatcaccggcgaccatccgatcaccgcccgggcgatcgcccgccagctgggactaccggcggacgcgcgagtcgtgaccggtgccgaacttgccgtcctggacgaggaggcgcatgccaaactcgccgccgacatgcaagtctttgctcgggtcagcccggaacaaaaggttcagattgtggcggcgctgcagcgctgcgggcgagtgaccgcgatggtcggcgacggcgccaacgacgccgcggccatccggatggccgacgtgggcatcggagtgagcgggcgcggttcctctgccgcccgtggggccgccgatatcgtgctgaccgacgatgacctgggcgtgctgctcgacgcgctggtcgagggccgcagcatgtgggccggtgttcgtgacgcggtgacgattctggtcggcggcaatgtgggcgaagttctgttcaccgtcatcgggacggcgttcggggccgggcgggcgccggtggggactcgtcaactgctgctggtgaatctgctcaccgacatgtttcccgcgcttgcggtggccgtcacctcgcagtttgccgaacccgacgacgccgaatacccaaccgatgacgcggccgagcgagcgcagcgcgaacatcgacgtgcggtgctgatcgggcctacgccctcgctggacgcgccattgctgcgtcagatcgttaaccgcggcgtcgtcaccgccgccggcgcaacggcagcctgggccatcgggcgctggactcccggaaccgaacgacgcacggcgacaatgggtttgactgcactcgtgatgacccagctagcgcagacactgctgacgcgccggcacagtccgctcgtcattgccaccgcactgggcagcgccggggtgttggtcggcatcattcaaaccccggttatcagccacttttcgggtgtaccccgctgggaccggtcgcctggacgggcgtcttcagcgccacggcaggagccaccgcagtctcagcgctggcaccgaagtggttggcaagcacagtcggtgtcgtgcaacctgatgaacgccctgacgacgcggaagactctgacgcgggtggatagaacctatcgacgccctcggtag

SEQ ID NO: 17 - DNA, 1578 bp, Mycobacterium Tuberculosis
atggcatccgacttcggcccgcgcatcgccgatcttgtcgaggtggcggcgacccggctgcccgaggctccggcgctcgtcgtcaccgcggatcgcatcgcgatcagccaccgcgacctggcccgtctggttgatgagctggccggccagctgacgcggtccggcctgctgcccggtgaccgggtcgcgctgcgcatgggcagcaacgccgaattcgtcgtcgccttgctggcggcgtcgcgtgcggatctcgtcgtcgtgccgctggatccggcgctgcccatcaccgagcaacgcgtccgaagccaggccgcgggagcccgggtggtgctgattgacgcggatgggccgcacgacagggcagaacccaccacccggtggtggccgctcacggtgaacgtcggcggtgacagcggcccctcgggtggcaccttgtcggtccacctggacgccgccaccgagccgaaccccgcaacctcgacgcccgagggactgcgacccgatgacgccatgatcatgttcaccggcgggacgaccggcctgccgaagatggtcccctggacgcacgcaaacatcgccagctcggtccgcgccatcatcaccgggtaccggctgagcccgcgggacgccaccgttgcggtgatgccgctctaccatggccacgggctgatcgcgtcgttgcttgccaccctggcgtccggcggcgcggtgtcgctgcccgcacgcgggcgattctccgcgcacaccttctgggacgacatcaaagccgttggagccacctggtatacggcggttccgacgattcaccaaatcctgctggagcgatcggcaaccgaaccgtcggggcgcaaacctgccgcactgcgtttcatccgcagctgcagcgcaccgctcactgcccaagccgcgctagcactgcaaaccgagttcgcggcaccggtcgtgtgtgccttcggcatgaccgaagccacccaccaggtaacgacaacgcagattgagggtatcgaccaaaccgaaactcccgtcgtgtcaaccggtctggtcggccggtcgacgggagcgcaaatccggatcgtcgggtccgacgggctgccactgcccgcgggcgcggtcggggagatctggctgcgggggaccaccgtggtacgcgggtatctgggtgacccgacgataaccgccgcgaatttcaccgacggttggttgcgtaccggtgatctcgggtccctgtcggcggccggtgacctgagcatccgcggccgcatcaaggaactcatcaaccgaggtggtgaaaagatctcgcccgagcgcgtcgagggcgtgctggccagccatccaaacgtcatggaggcagccgtattcggcgtcccgcaccagctctacggcgaggcggtcgcggcggtgattgtgcctcgtgagtccgccccgccgactcgcgaggagcttgtccagttctgccgggaacggttggcggccttcgagatcccggcctccttccaggaggccagcgggctgccgcacaccgcgaagggttcgctcgaccgccgcgctgtcgccgaacggttcggccattcggtgtag

SEQ ID NO: 18 - DNA, 2145 bp, Mycobacterium Tuberculosis
atggccgacagagtgaatgcttcccagggcgcggccgccgctcccaccgcaaacgggcccggcggcgttcgcaacgtggttctggtggggccctcggggggcggcaagaccaccctcatcgaggctctcctggtggcggccaaggtgttgtccaggccgggctcggtcaccgagggcaccacggtctgcgacttcgacgaggcggagatccggcaacagcgctcggtgggccttgcggtcgcctcgctggcttacgacggcatcaaggtcaacctcgtcgacacccctgggtacgccgacttcgtgggtgagctgcgggccgggttgcgggccgccgattgcgcactgttcgtgatcgcggccaacgagggcgtcgacgaaccgaccaagtccctgtggcaggaatgcagccaggtcggcatgccccgcgcggtggtcatcaccaagctggaccacgcccgggcgaactaccgggaagcgctgaccgcggcacaagacgccttcggcgacaaggtcttaccgctctacctgccgtccggtgacggcctgatcggattgctttcgcaggcactgtacgagtacgccgacggcaagcgaacgacacgaaccccggccgagtcggacaccgagcgaatcgaggaggcgcgcggcgccttgatcgaaggaatcatcgaggaatccgaggatgagtccttgatggagcgctacctcggcggcgagacgatcgacgagtcggtgctgatccaggatctggagaaagccgtcgcccgaggctcgttcttcccggtgattccggtgtgcagcagcaccggggtcggcacactggaattgcttgaggtagccacccgcggatttccgtctccgatggagcacccactgccggaggtctttaccccgcagggtgtcccgcatgcggagctggcctgtgacaatgacgcgccgttgctcgccgaggtggtgaagacgacgtcggacccctacgtcggccgggtcagcttggtgcgggtgttctccggaaccatcaggcccgacacgacggtccatgtgtcgggccatttctcatcgtttttcggcggcggaactagtaacacgcaccccgaccacgacgaagacgagcgcatcggagtcttgtcgttcccgctgggcaagcaacagcgcccggcagcagccgtggtcgcgggcgacatctgcgccatcggcaagctgagccgggccgagaccggggacacactctcggataaggccgagcccctggtgctgaaaccctggaccatgcccgagccgctgctgccgatcgccattgcggcgcatgccaagaccgacgaagacaagctgtcggtcgggttgggccggttggccgccgaagacccgacactgcggatcgagcaaaatcaagagacccatcaggtcgtgctgtggtgtatgggcgaggcccatgccggcgtcgtcctggatacactggccaaccggtacggcgtcagcgtagacacgatcgagctgcgggtgccgctgcgggaaaccttcgccggcaatgcgaaaggccatggccgccacatcaaacagtccggtggtcacggtcagtacggggtgtgcgacatcgaggtggagccgctgccggagggctccgggttcgagttcctcgacaaagtggttggcggggcggtgccgcggcagtttatccccaatgtggagaaaggtgtccgcgcacagatggataagggagtgcacgccggctacccggtggtcgatatccgggtcacgttgctcgacggcaaagcccacagcgtcgactcttccgatttcgccttccaaatggccggcgcgctcgcattgcgggaggccgcggccgcgacgaaggtgatcttgctcgagccaatcgatgagatttcggtgctggtacccgacgatttcgtcggcgcggtgttgggcgacctgtccagtcgtcgtggccgagtgctcggcaccgagaccgcggggcacgaccgcacggtgatcaaggccgaggtgcctcaggtcgagctgacccgctacgcaatcgatttgcgctcgctggcgcatggggccgcatccttcacccgttcgtttgcccgctacgaaccgatgccggaatccgccgccgcccgggtaaaggccggggccggctag

SEQ ID NO: 19 - DNA, 1344 bp, Mycobacterium Tuberculosis
atgccggtgcgacgccgcgccggggaacggttgccgacggtgtgggacttcgaaaccgacccgcaataccagtccaagctggattgggtcgaaaaattcatggccgaggaactcgaaccgctcgatctggtcgccctcgatccttacgacaaaaagaacgccgacacgatggcgatcctgcggccgctgcagcggcaggtgaaagaccaggggttgtgggccgcgcatttgcgtcccgaactcggcggacagggcttcggtcaggtcaagctggcgctgctcaacgagatcatcggccgctcccggtgggcgccgtcggcgttcggctgtcaggcgccggactccggcaacgccgagatcctggcgctgttcggcaccgacgagcagaaagcccgctatctacgaccgctgctcgacggcgagatcacctcctgctattcgatgaccgagccgcagggtggttccgatcccgggctgttcgtgaccgcggcgacccgcgatgccgcgggaaacggggactggatcatcaacggcgagaagtggttttccaccaacgccaagcatgcgtcgttctttatcgtcatggccgtcaccaagccggaagcccgtacgtacgagaagatgtcgctgttcatcgtcccggccgacaccccgggcatcgagatcgtgcgcaacgtcggtgtgggagccgagtccacccggcacgccagccacggctacatccgctaccacgacgtccgggtgccggccgatcatgtgctcggcggcgagggccaagcgttcatgatcgcgcagacccgattgggcggcggccgaatacatcacgcgatgcggacaatcgcgctggcgcgcagagcattcgacatgatgtgcgagcgtgccctgtcgcgccagactagacacgggcggctcgccgatctgcagatgacccaggagaagatcgccgatagttggatccagatcgagcagttccggctgctggtactgcgcaccgcgtggcttatcgacaaacaccacgactatcaaaaggtgcgccgcgacatcgcggcggtcaaggtggcgatgccccaggtgctgcatgacgtcgtgcagcgggccatgcacctgcacggcgcgctcggggtctccgacgagatgccgttcgtcaagatgatgctggcagccgagtcactgggcatcgccgacggcgccactgagctgcacaagatgaccgtcgcccgccgtacgctgcgcgaataccagccggtgacaacgcttttcccgtcacagcacattccgacccggcgcgcgcacgccgaggcctggctggcccaacgcctcgagcacgcgatcgccgaattctga

SEQ ID NO: 20 - DNA, 606 bp, Mycobacterium Tuberculosis
gtgacagcagtcgccgccggcgcgttggtcgtcgagaccgactcgtttcggctacggttgctcgacggcctggtcgcctcgatcggtgagcggggttatcgcgccaccaccgtctccgacatcgtccggcacgcccgcacatccaagcgcacgttctacgaccggttcaccagcaaggaacagtgctttttggaactcctgctagcggacaacgagacgttgggcaacagcatccgggcggccgtcgatccaaacgccgactggcacgaccagattcgtcaggcggtcgaggcctacgtcacccatatcgaatccaggccggcggtgacgttgagttggatccgtgaattcccgtcgctcggtgccgccgcttaccccgtccagcgccgcggcatggagcagctaaccagcctgctgatcgagctcagcgccagccctgggttccggcgggctaacctaccgccactgaatgtgccactggccgtaatcttgctgggcggtttgcgtgaactgaccgcgctgaccgtcgaggacggccagccgatccggaacatcgtcgagccggcggtggatgcgtcaatcgcgctgctcggtccccgcagctag

SEQ ID NO: 21 - DNA, 1326 bp, Mycobacterium Tuberculosis
atgagcgaagtcgtcaccgccgcaccggcaccgcccgtagtccgacttcccccggcggtccgcgggccgaagttgttccagggattggccttcgtggtgtcacggcgacggctgctggggcggttcgtgcgtcgctacggcaaggccttcaccgccaatatcctgatgtacggccgggtcgtggtggtcgccgacccgcagctagccaggcaggtcttcaccagcagtcctgaggagctgggcaacatccagcccaacctgagtcggatgttcggttccggctcggtgttcgcgctggacggcgacgaccaccggcggcggcgccggctactggcgccgcctttccacggcaagagcatgaagaactacgagaccatcatcgaagaggagaccctgcgcgagaccgccaattggccgcaaggacaggctttcgcaacgctgccgtcaatgatgcatatcacgctcaacgccatcctgcgtgcgatcttcggggccggcggcagtgaactagacgagctgcgccgcctcattccgccgtgggtcacgctgggctcgcgcctggcggcgctaccgaaacccaaacgcgactatggccgccttagcccgtggggccggctggccgagtggcggcgccagtacgacactgtcatcgacaagctcatcgaagccgagcgggccgacccgaacttcgccgatcggaccgacgtattggcgttgatgctgcgcagcacttacgacgacggttccatcatgtcgcgcaaggacattggcgacgagctgctcacgctgctggccgccgggcacgaaaccacggcggcgacactgggctgggcgttcgagcggctcagccggcaccccgacgtgctcgcggctctggtcgaggaggtcgacaacggcggtcacgagctgcgtcaagcggcgatcctggaggtacagcgggccaggaccgtcatcgattttgcggctcgtcgcgtcaatccacccgtttaccagctcggcgagtgggtgattccccgcgggtattcgatcattatcaatatcgcccagatacatggcgatcccgacgtcttcccgcagccggatcgcttcgacccgcagcgctacatcggaagtaagccatccccgtttgcgtggatcccttttggtggcgggacccgccgctgtgtcggggccgcattcgccaacatggagatggatgtggtgctgcgaacggtgctgcgccacttcaccctcgagaccaccacggccgcgggcgagcgcagccacggtcgaggagttgcattcaccccgaaggatggcggtcgggtggtgatgcgccgacgctga

SEQ ID NO: 22 - DNA, 954 bp, Mycobacterium Tuberculosis
gtgaccgaactcgacgacgtgtcctcgttaccatcctcgcgacggaccgctggcgatacctgggcgatcaccgaaagcgttggcgccaccgcgttgggggtcgcggcggcacgtgccgtggaaacggccgcgaccaatccgctgatccgtgacgagttcgccaaggtgttggtgtcgtcggcgggtaccgcctgggcacggctggccgacgccgatttggcctggctcgacggtgatcagctcggccgacgcgtgcatcgggttgcctgcgactaccaggcggtgcgcacccacttcttcgacgagtacttcggtgccgccgtcgacgcaggtgtccggcaggtggtgatcctcgctgccggactggacgctcgggcctaccgcctgaactggccggcgggcactgtggtttacgagatcgaccagccttcggtgttggagtacaaggcggggattcttcaatcgcatggcgcggttccaacggcgagacggcatgccgtcgcggtggacctgcgcgacgactggccggccgcgctgatagctgccggattcgatggcacccaaccgactgcctggctagccgagggcttgctaccctacctgcccggcgacgccgcggaccggctattcgacatggtcaccgcgctcagcgcaccgggcagccaggtcgctgtcgaggctttcaccatgaacacaaagggcaacacgcagcgctggaatcggatgcgcgagcgactcggtttagacatcgatgtccaggcgttgacctaccacgagcccgaccggtcggatgccgcgcaatggctggccacgcatggctggcaggtgcacagcgtgagcaatcgcgaggagatggcccgactgggccgggcgatcccgcaagacctggtcgacgagaccgtccgcaccacgttgctgcgagggcgtctggtcacacccgctcaaccggcgtga

SEQ ID NO: 23 - DNA, 1152 bp, Mycobacterium Tuberculosis
gtgccggcagtgcagccatggttgtattccaacatgcctgccatccggggcgcggtgctagaccagatcggtgtgccgcggccctattggcggtcgaaaccaatcagcgtcgtcgagctgcacctggacccgcccgaccgcggtgaggtccttgtccgaatcgaggctgcgggcgtgtgccactccgacctgtcggtggtcgacggcacccgggtacggccggtgccgatcttgctcggtcatgaagccgctggaatcgtcgagcaggtcggcgacggcgtcgacggggtcgcggtcggtcagcgagtcgtgctggtgttccttccgcgttgcggccagtgcgcggcgtgcgcgaccgacggtcggacgccgtgcgaaccgggcagcgcggccaacaaggccggcacactgctcggtggcggtatccggctcagccggggcggccgcccggtgtaccaccacctcggcgtctcgggtttcgcgacccatgtcgtcgtcaaccgggccagcgtggttccggtgccgcacgaggtgccgcccaccgtcgctgccctactcgggtgcgcggtgctcaccggtgggggtgcggtactcaacgtcggtgatccgcagcccggccagtcggtcgccgtcgtcggcctcgggggcgtcggtatggcagcggtgctcaccgctttgacgtatacagacgttcgtgtggtcgccgtcgatcagctacccgaaaagctgtcggccgcaaaggccttgggcgcccatgagatctacacaccgcagcaggccacggccggcggggtcaaagccgccgtggttgtcgaagccgtcggtcatcctgccgcgctgcacaccgcgatcgggcttaccgcgcccggagggcgcaccatcaccgtcgggttgccgccaccggatgtccggatcagcttgtcgccgttggattttgtcaccgaaggccggtcactgatcggcagctatctgggttcggcggtgcccagccacgacattccccgcttcgtgtcgttgtggcaatcgggccgtctgccggtggagtcgctggtgacgtcaacgattcggttggacgatatcaacgaggcgatggaccacctcgccgatggcatcgcggtgcgtcagctcatcagtttcaccggtgatctctaa

SEQ ID NO: 24 - DNA, 456 bp, Mycobacterium Tuberculosis
atggctgcactgccggcaccggagaagctcctgcgcagcgactttccggtgctgtggccggtgggaactcgatgggccgacaacgacatgttcggccacctcaacaacgccgtctactaccagctgtttgacaccgcgataaacgcctggatcaacacgagcaccggggttgacccgctcgcgatgcctgtgctgggcattgtcgcggagtcgggctgccgttatttctcggaactgcgtttcccggagagcctaatggtgggcctggctgtgacgcggttggggcgcagcagcgtcacctaccggctgggtgtgtttaaggagcctgacgatgcgggggtgatcaccgcactcgggcactgggtgcacgtctatgtcgatcggactagccgcaggccggttccgattcccgaggccattcggtcgctgttgtcgacggcttgcgtaagcggataa

SEQ ID NO: 25 - DNA, 795 bp, Mycobacterium Tuberculosis
ttgataaagcatgatgttgtctgggtcacactatggcctgagcggcccaacaacaagcccccgccaagcccccggcaagtccccggcaatcccggcccgaccctgaaagtcctggcaagccacgtgaacgcacctctatcggcgaagccgcggagccagcttcccctgcgccgggcacagttgtccgacgaggtcgcgggccacctgcgggccgccatcatgtcgggcgccctgcgctctggaacgttcatccgtctcgacgagacggcagccgagctcggagtcagcgtcacgccggtgcgggaggcgctgctgaaactgcgcggtgaggggatggtcgggctggagccacatcgcggccacgtggtgctgccgttgacccgccaagacatcgacgacattttctggctgcaggccaccattgcccaagaacttgccacatcggccaccgctcacatcaccgacgttgagatcgacgagctggaccgcatcaacaatgcgctggccggtgctatcgggtccggtgatgccaaaaccatcgcgtcgatcgagttcgcgttccaccgcgtcttcaacaaagcgagccgccggatcaagttggcctggttcctgcttaatgccgcgcgctatatgggcgcaggtgttcgcggccgacccgcgatggggcgcggacgcggtgaacagtcatcggcagctgatcgccgcgctgcgccgccgcgacacagccgccgtaatcgagcacaccgtctggcagttcaccgatggggcacgcaggctgacggaggccctggctga

SEQ ID NO: 26 - DNA, 1548 bp, Mycobacterium Tuberculosis
atgagaacgctggaaccacccaaccgaatgcgaattgggctcatgggcatcgtcgttgcgctgctcgttgtcgctgtgggccaaagctttaccagtgttcccatgctattcgcaaagccgagctactacggccagttcaccgactccggcggactgcacaagggcgacagggtacgcatcgccggcttgggagtgggcaccgtggaggggctcaagatcgacggcgaccacatcgtggtcaagttctccatcggcaccaacaccatcggcaccgagagccgcctagccatccgcaccgacaccatcctgggtaggaaagtgctcgagatcgagccgcgcggcgcccaagcgttgccgcccgggggcgttttgccggttgggcaaagcaccaccccgtaccagatttacgacgcgttcttcgacgtcaccaaggccgcatccggctgggacatcgagacggtcaagcggtcgctgaatgtgttgtcggagaccgttgatcagacctatccgcacctgagcgccgccctcgacggggtggctaagttctccgacaccatcggcaagcgcgacgagcagatcacgcacctactagcccaggccaaccaggtggccagcatcctgggtgatcgcagtgagcaggtcgaccgcctattggtcaacgctaagaccctgatcgccgcgttcaacgagcgcggccgcgcggtcgacgccctgctggggaacatctccgctttctcggcccaggtgcaaaaccttatcaacgacaacccgaacctgaaccatgtgctcgagcagctgcgcatcctcaccgacctgttggtcgaccgcaaggaggatttggctgaaaccctgacgatcttgggcagattcagcgcgtcgttcggtgagacgtttgcctctgggccctacttcaaagtgctgctggccaacctggtgccgggtcagatcttgcagccgtttgtcgatgcggcattcaagaagcgtggtattagcccggaggacttctggcgcagcgccgggctgccggcataccggtggcccgaccccaatggcacccggttccccaacggtgcgccgccgccaccaccgccggtgttggagggcacgcccgagcatcccgggccggcggtgccgccgggatcgccgtgctcctacaccccgccggcggacggtctgccgcggccgtgggatccgctgccctgcgctaacctcactcaaggtccattcggtggccccgatttcccggcgccgctggatgtcgcgacgtcgccgccgaacccagacggtccaccgcccgccccgggcctaccaatcgcgggacgtccgggtgaggtgccgccgaacgttcccggcacgccggtgccgattccacaggaggctccccccggggcacgcacgctgcccctcgggccggcgcctggtccggctccgcccccggcggcgccaggcccgccggcaccaccgggccccgggccgcagttgccggccccgttcatcaaccccggcggcaccggcggtagtggcgtgacgggaggtagcgagaattga

SEQ ID NO: 27 - DNA, 1548 bp, Mycobacterium Tuberculosis
gtgctgactcgcttcatccgacgccagttgatcctttttgcgatcgtctccgtagtcgcaatcgtcgtattgggctggtactacctgcgaattccgagtctggtgggtatcgggcagtacaccttgaaggccgacttgcccgcatcgggtggcctgtatccgacggccaatgtgacctaccgcggtatcaccattggcaaggttactgccgtcgagcccaccgaccagggcgcacgagtgacgatgagcatcgccagcaactacaaaatccccgtcgatgcctcggcgaacgtgcattcggtgtcagcggtgggcgagcagtacatcgacctggtgtccaccggtgctccgggtaaatacttctcctccggacagaccatcaccaagggcaccgttcccagtgagatcgggccggcgctggacaattccaatcgcgggttggccgcattgcccacggagaagatcggcttgctgctcgacgagaccgcgcaagcggtgggtgggctgggacccgcgttgcaacggttggtcgattccactcaagcgatcgtcggtgacttcaaaaccaacattggcgacgtcaacgacatcatcgagaactccgggccgattttggacagccaggtcaacacgggtgatcagatcgagcgctgggcgcgcaaattgaacaatctggccgcacagaccgcgaccagggatcagaacgtgcgaagcatcctgtcccaggcggcccccaccgccgatgaggttaacgcggtattcagcggtgttcgcgattcgctgccacagaccctggccaatcttgaggttgtgttcgatatgctcaagcgctaccacgccggcgtggagcaattgttggtgttcctcccacagggtgccgcgatcgcacagaccgtactcacgccaactccgggtgctgcccagctgccgctcgcgccggcgatcaactatccgccgccgtgcttgacgggttttcttcctgcatcggagtggcggtctccggccgataccagtcccaggccgttgccgtcgggaacctattgcaagattccccaggatgcccagctgcaagtccggggggcgcgcaacattccctgtgtcgatgtcctgggcaaacgagcggcgacgccgaaggagtgccgcagtaaggacccgtacgttccgctgggtaccaacccgtggtttggtgatccgaaccagattctcacctgcccggcacctggagcgcgctgcgatcagccggtgaagcccgggttggtgattccggcgccctcgatcaacaccggtttgaatccggcgcccgccgatcaggtgcaaggaacgcccccgccggtcagtgacccgttgcaaagaccgggttcgggtactgtgcagtgcaacgggcagcagcctaacccgtgcgtctacactccaacatcgggcccgtcggcggtctatagcccggccagcggtgaactggtggggccggatggtgtcaagtacgccgtcgcaaactcgagcacaacaggagacgacggatggaaggagatgctggcgccggccagctga

SEQ ID NO: 28 - DNA, 735 bp, Mycobacterium Tuberculosis
gtggaagatcagcagtctgcttccggtgatctgacccaaaagtccgttgccaacggagagtccaccgacacggcatccgcagccaccgagggccaccggggcgagatcgacgccgcgggagagccggacgaacgcggtgccgccgtggctgacagccaagctgacgaggatgattcggccgcgacggctgccaggggcggcaagacacgggcaagacgatcgcgtggcaggcggttagcgatcacggtcggcgtggccgctgcgttgttcgtgggctcggcagcgttcgctggtgcgacggtggagccctacctctccgagcgcgccgtggtggccaccaagctcatggtcgcgcggaccgccgccaatgcgatcacgacgttgtggacctacacgccggagaacatggacaccctggccgatcgggccgcgaattacctcagcggtgatttcgcggctcagtaccgcagattcgtcgaccagatcgccgcagcaaacaaacaggccaagattaccaacgataccgaggtcaccggtgctgccgtggaatcgctgagcggccgggatgccgttgccatcgtctacaccaacaccacgaccaccagtccggtgaccaagaacatcccagcattgaagtatctgtcctaccggctgttcatgaagcgttatgacgcgcggtggctggtgaccaggatgacgaccatcacctcgctggatttgacgccgcaggtgtag

SEQ ID NO: 29 - DNA, 2076 bp, Mycobacterium Tuberculosis
atgaccgacgacgagcgattctcactgttggtcggcctgaccggggccagcgatctgtggccggtgcgcgatgaacgcatcccacagggcgtgccgatgtgtgccgggtatgtgccggggattccccggctcggggtcccggccttgttgatgagcgatgccggtctgggcgtcaccaaccctggctaccgccccggtgacaccgctacggcgctgcccgccggccttgccctagcggccagctttaacccggtgctggcccggtcctcgggcaaagcgatcggccgggaggcgcgcagtcgcgggttcaacgtgcaactggccggcgcaatcaatctggcgcgcgacccgcgtaacggccgcaacttcgagtacctttccgaggacccgttgttgagtgccacgatggccgcggagtcgatcatcgggattcagcagcagggtgtcattgcgacgacgaaacacttctcgctgaactgcaacgaaaccaatcggcactggctggacgcggtcatcgatcccgacgcgcaccgcgagtcggacttgttggcgttcgagatcgtcatcgagcggtcgcagcccggcgccgtgatggcggcgtacaacaaggtcaacggagattacgctgccggcaacgaccacttgctcaacgacgtgctgaaaggtgcttggggataccgcggttgggtgatgtcggattggggcggaacacccagctgggagtgcgcgctggccggcctggaccaagagtgcggtgcgcagatcgatgcagtgctgtggcagtcggaagcattcaccgaccgcctgcgtgccgcctacgccgacggcaatctacccaaggggcgcctgtcggacatggtacggcggatcctgcggtcgatgtttgccgtcggaatcgaccgatggaaaccagcgccggcgccggacatgaatgcgcacaacgagattgccgcacagatggcgcggcaaggaatcgtgctgctgcaaaaccgagggctgctgccgctcgctcccgaatcggccgggcgtattgccgtcatcggcggctatgcacacctcggtgtgccagccggttacggttcgagcgccgtcaccccgccggggggctatgcgggcgtgataccgatcggtgggtctggcttggcagccgggttgcgtaatctctacctgctgccgtcaagcccgctgagtgagttgcgaaagcggttgcccaacgcgcagttcgagttcgatcctggcatcaacccggcggaggcggtgctggctgcgcggcgagcagacatcgcgatcgtgttcgcgatccgtgccgaaggagagggcttcgacagcgccgatctgtcgctgccatggggtcaggatgcgctgatcgccgcagtcgcgtccgccaacgcgaataccgttgtggtgcttgagacgggcaacccggtgaccatgccctggcgcgactcggtgaacgccatcatgcaggcctggtatccgggccaggcgggtggccaggccgttgcggagattgtgaccgggcaggtgaatccttcgggccggctgccgatcaccttcccggtcgatctcggtcagacgccacgctcgcaaccgcccgagctcggtgccccgtgggggacatcgaccacgatccactacaccgagggcgccgatgttggttaccgctggtttgccagcacaaatcagaccccgatgttcgcgttcggtcacggcttgtcctataccagtttcgagtatcgtgacctggtggtgacgggcggccacaccgtgcacgccagtttcagcgttaccaacacgggcgaccgcagcggggcggatgtcccgcagctgtatatgatcgcagctcccggcgaatcgcggttgcggttgctgggattcgagcgggtcgagctcgaacccggccagactcggcgggtaaggatcgaggcggacccgcgactgctcgcccgctacgacggcgaggccagaagctggcgcatcgagccgggcggttacacggtggcggtgggcgcttcggcggtagcgctgaagctggcagccaaggtcaagctggccggccgtgggttcgggcggtga

SEQ ID NO: 30 - DNA, 663 bp, Mycobacterium Tuberculosis
ttgggcatggaccagcaacccaacccgcccgacgtcgacgcatttttggacagcacactggtcggcgacgatccggcgttagccgcggcattggcggccagcgacgcggccgagttaccccgcatcgcggtgtcggcacagcagggcaagttcctgtgcctgctggccggtgccatccaggcgcgccgcgtcctcgagatcggcacactcggtggcttcagcaccatttggctggcgcgtggcgcgggcccacagggacgggtggtcacgctggaataccagcccaagcacgctgaggtcgcccgggtgaacctgcagcgagcgggcgtcgccgatcgggtggaggtggtcgtcggtccggcgctggacacgttgccgacgttggccggtggcccgttcgacctggtgttcatcgacgccgacaaagagaacaacgtcgcatatattcagtgggcgatccggttggcccggcgcggcgcagtgatcgtggtggacaacgttattcgtggcggcgggattcttgctgagtccgacgatgccgacgcagtggcggcacgtcggacgctgcaaatgatgggtgagcaccccggcctagacgccacggcgatccagaccgtcgggcgcaagggctgggacggtttcgccctcgctttggtgcggtag

SEQ ID NO: 31 - DNA, 1242 bp, Mycobacterium Tuberculosis
atgactgccccaaccggaacctccgccactacgacgcgaccgtggacgccacggatcgccacgcaactgtccgtgctggcttgcgcggcctttatctatgtcaccgccgaaatcctgccagtgggcgcgctgtcggcgatagcgcggaacttgcgcgtcagcgtggtcctagttgggaccttgctgtcctggtatgcccttgtcgcggccgtgacaacggttccgctggtgcgttggaccgcacactggccgcgccgccgggccctggtggtcagcctggtctgcctgaccgtctcgcaactcgtctcggcgctggcgcccaacttcgcggtgctggccgccgggcgggtgctctgcgcggtcacccatggcctgctgtgggcggtcatcgcgccgatcgccacccggctggtgccgcccagtcacgccgggcgcgccacgacgtcgatctacatcggaaccagtctggcgctggtcgtcggtagcccactcacggctgccatgagcctgatgtggggttggcggctggcggcggtgtgcgtgaccggcgcggcggccgcggtcgccctggccgcccggctggcgttgccggagatggtgctgcgcgccgaccagctcgagcacgttggccgacgggctcgtcaccaccgtaatcctcgcctggtcaaggtcagtgtgctcacgatgatcgcggtaaccggccatttcgtgtcctacacctacatcgtggtgatcatccgcgacgtcgtcggtgtacgtgggccgaatctggcctggctgctcgccgcctatggggtcgccggcctggtgtccgtgcccctggtggcgcggccgttggaccgttggcccaagggcgccgtcatcgtcggtatgaccggactgacggcggcgttcaccttgctgaccgcgctggcattcggtgaacgccacaccgcggcgacggcactgctgggcaccggtgcgattgtgctgtggggagccttggccactgccgtgtcaccgatgctgcaatcggcggcgatgcgtagcggcggcgacgaccccgacggggcctcaggtttgtatgtgacggcgtttcagatcggcatcatggccggcgctctgctgggtgggctgctctacgagcgcagcttggcgatgatgctgaccgcgtcggcgggtttgatgggtgttgcgttgttcgggatgacggttagccagcacttgttcgagaatccgactctgagtcccggcgacggctaa

SEQ ID NO: 32 - DNA, 1992 bp, Mycobacterium Tuberculosis
gtgacacttgccatcccctcgggtatcgacctgagccacatcgacgctgatgcccgaccccaagacgacctgttcggccacgttaacggccgctggctggctgaacacgagataccagcggaccgagcgaccgacggcgccttccgtagcctgttcgaccgcgccgagacacaagtgcgagacctgatcatccaggccagccaagcaggtgctgcggtaggcaccgatgcgcagcgcatcggcgacctctacgccagcttcctcgacgaggaagccgtcgagcgcgcaggggtgcaaccgctgcacgacgaattggccacgattgacagcgcggccgacgccaccgaattggccgccgcccttggcactctgcaacgtgccggcgtgggcggcggcatcggagtctatgtcgataccgattccaaagactcgacccgttacttggtgcatttcacccaatccggcatcggattacccgacgagtcctactaccgtgacgagcaacacgccgccgtgctagcggcctacccggggcacatcgcccggatgttcggcctggtgtacgggggcgagagccgtgaccatgccaaaaccgcggaccgcatcgtcgcgctggagaccaaactcgccgacgcgcattgggatgtggtgaagcgccgcgacgccgaccttggctacaacctgcgcacgtttgcccagctgcagaccgaaggggcgggtttcgactgggtcagctgggtgaccgcattggggagcgctccggacgccatgacggaactggttgtgcgccaacctgattacctcgtcacctttgcctcgctgtgggcgagcgttaacgttgaagactggaaatgctgggcgcgttggcgtttgatccgcgcccgggccccctggctgacccgcgccctggtcgccgaggacttcgaattctacggccgcacgcttaccggcgcacagcagcttcgggaccgttggaagcgtggggtgtcactggtggagaacctgatgggcgatgccgtcggaaagctctatgtacaacgccatttcccgccggatgccaagtcccgcatcgacaccctggtggacaacctgcaggaggcgtatcggatcagcatcagcgagctggattggatgacgccgcagacccggcaacgcgcgctagcgaagctgaacaagttcaccgccaaagtcggctatccgatcaagtggcgcgactactcgaagctggcgatcgaccgcgacgacctctacggtaacgtccagcgcggctacgccgtcaaccatgaccgcgagctagccaagcttttcggcccggtcgaccgcgacgagtggttcatgacaccacaaaccgtcaacgcctactacaacccggggatgaacgaaatcgtcttccccgcagcgattttacagccaccatttttcgatccgcaggccgacgaggccgccaactacggcgggatcggggcggtgatcgggcacgagatcgggcacggtttcgacgatcagggcgccaaatacgacggcgacggcaatctggtcgattggtggaccgacgacgatcgcaccgagttcgccgcccgcaccaaagcgttgatcgagcagtaccacgcttacacgccgcgcgatctcgtcgaccaccccggcccgcctcatgtgcaaggcgcgttcaccataggcgagaacatcggcgacctgggcgggctgtcgatcgccctgctggcttaccagctctcgctgaacggcaaccccgctccggttatcgacgggctgaccggcatgcaacgggtgttcttcggctgggcacaaatatggcgaaccaaatcgcgtgcagccgaagcaatccgccggttggcggtcgatccgcactccccgccggagttccggtgcaacggtgtggttcgcaacgtggacgctttttatcaggccttcgacgtcaccgaggatgacgcgctgtttctggacccgcagcgcagggtccggatctggaactag

SEQ ID NO: 33 - DNA, 411 bp, Mycobacterium Tuberculosis
atgaagacaggcaccgcgacgacgcggcgcaggctgttggcagtactgatcgccctcgcgttgccgggggccgccgttgcgctgctggccgaaccatcagcgaccggcgcgtcggacccgtgcgcggccagcgaagtggcgaggacggtcggttcggtcgccaagtcgatgggcgactacctggattcacacccagagaccaaccaggtgatgaccgcggtcttgcagcagcaggtagggccggggtcggtcgcatcgctgaaggcccatttcgaggcgaatcccaaggtcgcatcggatctgcacgcgctttcgcaaccgctgaccgatctttcgactcggtgctcgctgccgatcagcggcctgcaggcgatcggtttgatgcaggcggtgcagggcgcccgccggtag

SEQ ID NO: 34 - DNA, 1479 bp, Mycobacterium Tuberculosis
gtgatccgcgcggctagtgatgacccggccggggtggacgagctggtggcagcgatcgcgccggggcttgccgggctgggtttgccggtcatcaaccgccgcgaggtggtgctggtgaccggtccgtggctggccggggttagcggtgtgcgcgcggcactggccgaaaggctgccgcagcgtaggttcgtcgagacggcagagttgggacccggcgatgcgccggtggcggtggtgttcgttgtttccgcggcaaccgcgctgaccgaatccgattgcgtgttgctggacaccgccgcggagcacaccgatgcggtggtagctgtggtgtccaagatcgacgtgcaccgcggctggcgtgacgtgcttaccagtaaccgcgacaggctggccgcgcgcgcgtcccgctacgcccgggtgccctgggttggcgcggccgccgcacctgagctgggcgagccatacctggacgacttggtcgccgccatccagaaacagctcgccgatccggctgtcgcgcggcgaaacatgttgcgtgcgtgggaatcccggcttctgatggtcgcgcggcggttcgatggcgatgcacagagcgccggtcggcgggcacgggtcgacgcgttgcgccagcaacggcgcacggtcctgcggcaggggcgtcaatcgaagtctgaacacaccatcgcgctgcgcgcgcagatccagcacgctcgggtcaaattgtcctactttgcccgcaatcggtgttcgttgctgcgcgtcgagctgcaggagcacgtcgccggtctgtcccggaaggacatcgccaggttcgcggcatacacgcgcggccgggtccaggaggtggtcgccgaggtgggcgaaggtgccgtcgcgcaccttgccgacgtcgcgcagctgttgggtgtgccggtgcagccaccggtcctcgagaacctcccggcggtgctcccgacggttgtggccccgccactgacatcacgacgattggagatccggctgacaacactcttgggcgccgggttcgggctgggtatcgcgctgaccctgagcaggctggtggcgggtcttactcccggcctggctgcatcggggatggtggcgggtgtggcgatcggcctggcggtgaccgcctgggtggtgaatgcccgcgcgctgctgcacgaccgtgtcgtggtggaccgctggacgggtgaggtgacggcatcgctgcggtccgtggtggagcagctggtcgccactcgggtggtggctgtcgagacgctgctgagcaccgcgattagtgaacgcgacgacgccgagaacgcccgggtggccgatcaggtcagcatcattgacggcgaactgcgcgaacacgccgtcgctgcggcgcgggccgcggccctgcgtgaccgggagatgccggcggtgcgggccgcacttgaggcggtgcgtgcagaactcggcgagccgggtgcgcccacaacaggcctgttctga

SEQ ID NO: 35 - DNA, 1074 bp, Mycobacterium Tuberculosis
gtgcgcaacgagctcaacgacgacgaagcgatgctggtcgccaccgtgcgggcattcatcgaccgagacgtgaagccaaccgtccgtgaggtcgagcatgccaatagctacccggaggcgtggatcgagcagatgaaacacatcggcatctacggcctggcgatcgacgaacagtacggcgggtcgccggtgtcgatgccgtgctatgtgcaagtcacccaggagctggcacgcggctggatgagcctggccggcgcgatgggcgggcacaccgtcgtcgccaaattgctgaccctgtttggcaccgaggaacagcggcggacatatctgcccccgatggccagtggcgagctgcgggccaccatggcgctaaccgagcccggcggtggctcggatctgcagaacatgtcgaccacggcgttggccgacggccctgaaggctctgccgggttgttgatcaacggctgcaagacgtggatcagcaacgcccgccggtccggacttttcgcggtgctgtgcaagaccgacccgaacgccacaccgcggcaccaaggcatgtcgatcgtgctcgtcgaacccgggccgggactcacggtgtcgcgggacttgccgaagttgggttacaagggcgtcgaatcctgcgagctgtcgttcgacaacctccgggtgccggtctcggcgatcctgggcggagccatgggtcaaggcttttcgcagatgatgaagggacttgaaacgggtcgcatccaagtggccgcgcgggcgctgggcgtggcgacggcggcactcgaggactcgctggcctacgctcagcaacgggaaagctttggccgaccgatctggcagcatcaggcggtcggcaattacctggccgacatggcgaccaagctcacagcggcccgtcagctgacccgctatgccgccgagcggtacgacagcggccaacgctgcgatatggaggccgggatggccaagttgttcgcctccgaggtcgcgatggaaatcgccctaaacgccgtgcgtatccacggcggctacggctactcgaccgagtacgacgtggaacggcggtga

SEQ ID NO: 36 - DNA, 789 bp, Mycobacterium Tuberculosis
atgagcagcgaaagcgacgcagccaacaccgaacctgaggttctggtagaacagcgggatcggattttgatcatcacgatcaaccgcccgaaagccaagaacgcggtcaacgccgcagtcagccggggcttggccgatgcgatggatcagcttgacggcgatgccggcctgtcggtggcaatcctgaccggtgggggcggttcgttctgcgcgggcatggacctcaaggcgttcgcccggggcgagaatgtcgtcgtcgaaggtcgcggccttggctttaccgaacgtccgccgaccaagccgctcattgctgcggtggaaggctacgcgttggcgggtggcaccgagctggcgcttgctgccgacctgatcgtggcggccagggattcggcgttcgggattcctgaagtcaagcggggtctggttgccggcggcgggggattgctgcggttgccggagcgcatcccgtatgcgatagccatggagttggcgctgaccggtgacaacctaccggccgaacgcgcgcacgagctggggctcgtcaacgttttggccgagccggggaccgccctcgatgctgcgatcgcgttggcggagaagatcaccgccaatgggccgctggcggtggtggccaccaagcggattatcaccgagtcgcgtgggtggagtcccgacactatgttcgctgagcagatgaagatcctggtgccggtgttcacctccaacgacgcgaaggaaggtgcgatcgcgttcgccgagaggcgccggccccgttggacgggcacctag

SEQ ID NO: 37 - DNA, 1266 bp, Mycobacterium Tuberculosis
atgttgcggttcgccgcgtgcggcgctatcggactcggagccgccctactgatcgccgccctgctgctgtcgacctataccaccagcaggatcgctgagatcccactcgatatcgatgccacgttgatcagcgacggcactggaacggcactcgactcggcgtcgctagccaccgagcacatcgtggtcaaccaggacgtgccgctggtgtcccaacagcaagtcaccgtcgaatcgcccgccaacgccgacgtggtcacacttcaggtcggatcctcgctccggcgcaccgacaagcagaaggacagcgggctgctgctggcgatcgtcgacacggtcaccctcaaccgcaagacggcgatggctgtctccgacgacacccacaccggcggcgccgtccagaaaccgcggggcctcaatgacgagaacccgccgacggccattccgctgcggcacgacgggctgtcttaccggttcccgtttcacaccgagaagaagacatacccctatttcgaccccatcgcacagaaggcgtttgacgccaactacgaaggcgaggaggacgtcaacggtttaaccacataccgcttcacgcagaacgtcggctacacccccgaggggaagctggtggctcccctcaaatacccgtcgctgtacgccggcgacgaggacggcaaagtcaccacatcagcggcgatgtgggggctacccggtgatccgaacgagcaaatcaccatgacccgctattacgcggcgcagcgaacattctgggtggacccggtgtccggcaccatcgtcaaagaaaccgaacgcgccaaccactacttcgctcgtgacccactcaaaccagaggtcacgtttgccgactaccaggtcacctccaccgaagagacggtcgaatcccaggtcaacgcggctcgcgacgagcgcgaccggctggcgctgtggtcgcgggtgctgccgattacattcaccgcggccggcttggtcgcgctggtcggcggtggtctgttcgcgtcgtttagccttcggaccgaaggtgcgctgatggctgccagcggggatcgggacgaccacgattaccgccgcggcggcttcgaagaaccggtgcctggagcggaggctgagaccgagaaactgcccacgcagcgccccgacttcccgcgcgagccgagtggctcggatccgccccgactcggttcggcgcagccgcccccaccgccggacgcggggcatcccgaccccggcccgcccgagcggcgctaa

SEQ ID NO: 38 - DNA, 1536 bp, Mycobacterium Tuberculosis
atgcgatcggtgacatgttccgccacgctggtcctgcccgtgatagagcccaccccagccgataggaggccccgacacctcctgctcgggagcgctggccacgttagtggcaggctggacaccggacgatttgtgcaaacccacccagcaaaggatgtcagcgtgcccatcgccaccatcaacccggctaccggcgaaacagtcaagacattcactgcggcgaccgatgacgaagtcgacgcggcaatagcccgggcccaccggcggttcgccgactaccgccagaccagcttcgcccagcgcgcccggtgggccaatgccaccgccgacttgctggaagccgaggccgaccaggccgccgcgatgatgacgctcgagatgggcaagacgctggccgcggccaaagccgaggcactgaagtgcgccaagggttttcgctactacgccgaaaacgccgaggcgttgctggccgacgaacccgccgatgcggccaaggtcggggcgtcggcggcctacggccgataccagccgctcggggtgatcctggcggtgatgccatggaacttccccctgtggcaagcggttcggttcgccgcaccggcactgatggccggaaacgtcggcctgctcaagcacgcgtcgaacgtgccgcaatgcgcgctgtacctggccgacgtcatcgcccgaggcggcttcccggacggctgcttccagacgttgcttgttagctcgggagccgtcgaagccatcctgcgtgatccccgggtcgcggcggccacgctgaccggaagcgagccggccggccaatcggtgggcgctatcgccggtaacgagatcaagccgaccgtgctcgagctcggcggcagcgacccgttcatcgttatgccgtcggccgatctggacgccgcggtcagcaccgccgtcaccggccgggtgcagaacaacggccaatcctgcatcgccgccaagcggttcatcgtccacgccgacatttacgacgatttcgtcgacaagttcgtcgcgcggatggcggcgttacgggtcggcgacccgaccgacccggacaccgacgtgggcccgctggccaccgagcagggccgcaacgaggttgccaagcaagtcgaggatgctgccgcggcgggcgcggtgatccggtgcggcggaaagcgtctcgaccggccgggctggttctacccgccgaccgtgatcaccgacatctccaaggacatggctctctacaccgaggaggtcttcggtccggtcgcctcggtgttccgcgcggcgaacatcgacgaggccgtcgagatcgccaacgccaccaccttcgggctgggatccaacgcctggacccgcgacgagaccgagcaacgacgcttcatcgacgacatcgtggcgggccaggtttttatcaacggcatgacggtgtcctatcccgaattgccgttcggcggggtcaagcgctcgggctatggccgggaactgtccgcacacgggatacgcgagttctgcaacatcaagaccgtctggatcgcctag

SEQ ID NO: 39 - DNA, 1449 bp, Mycobacterium Tuberculosis
atgggatggttttcagcgcccgaatattggctgggcagactggcgctggagcgcggcacggcgattatttatctgatcgcattcgtcgcggccgcacagcagttccggcccctcatcggagagcacggcatgctgccggtgccgcggtatctggctggacagtccttctggcgaacaccgagcatctttcactttcgctattccgatcgggtgttcgccggggtctgctggttgggtgccgtgttgtcggcagccgtcgtcgccggtgcggcctccttcgtgccgttgtgggccacgatgctgatctggctgacgctgtgggtgctctacctgtccatcgtcaacgtcgggcaggcgtggtactcattcggttgggagtcgctgctgctggagaccggcttcctgatgatcttcctcggaaacgagcgcaccgccccgccgattctgacgttgttgttggcgcgctggctgctgttccgggtcgaattcggtgccggattgatcaagatgcgcggcgactcgtgctggcgcagtctgacgtgcctgtactaccaccacgaaacacagcccatgccgggcccgttgagctggttcttccatcacctgcctaagccattgcaccggattgaggtggcgggcaaccatttcgcccagctcgtggtgccgtttgggttgttcacaccacagcccgcagccagcatcgccgccgcgatcatcgtggttacccagctatggctggtggcatcgggaaatttctcctggctcaattggctgaccatcctcttggcgtgcagcgcgatcgacacatcttcggccgcggcgctgctgccgatgccggcccagccggcgctgtcggcaccgccgcagtggttcgccggcctcgtggtcgtattcaccgcggcggtgctgttgctgagctactggccggcacgcaatctgctgtcctctcatcaacgaatgaacatgtcgttcaacccctttcatttggtcaacacctacggggcgttcggcagcatctgccgcacccgccgggaagtggtaatcgaagggaccgacgagtcaccgattaccgaacaaaccgtctggaaagcatacgaattcaagggcaagcccggtgatccgcgccggctgccgcggcaatgggccccctaccatctgcggctggactggctcatgtggttcgccgccatctcaccgggctacgcactaccgtggatgacgccattcctaaaccggttgctgcgcaatgatcctgcgacgctgaagctgttgcgccacaatcctttcccgcaatctccgcctcggtatgtgcgcgcgcagctgtatcagtaccgcttcaccaccgtggccgagctgcgacgggaccgagcctggtggcaccgcacgctgatcgggcgctacgtcccgccgatgtcgctacgcaaagtcgcctcgccaccggccgattga

SEQ ID NO: 40 - DNA, 234 bp, Mycobacterium Tuberculosis
atgattcgaacgcaagtccagctcccagatgagctttaccgggacgccaagcgggtcgcgcacgagcacgaaatgacccttgccgaggtcgttcgtcgcgggctggagcacatggtgcggatctatccgaggcgcgatgcggcgtccgacacctggcagccgcccacgccgcgtcgactcggtccgtttcgtgcgtccgaagaaacgtggcgcgagctcgccaacgaggcgtga

SEQ ID NO: 41 - DNA, 843 bp, Mycobacterium Tuberculosis
gtgactcaacccagcggcctgaagaacctgctgcgcgcggcggccggggcgctacccgtggtgccccggacagaccagctgcccaaccggacggtgaccgtcgaggagctgccgatcgaccccgccaacgtcgcggcctacgcggcggtcaccggtctgcgctacggcaaccaggtgccgttgacctatccgttcgcgttgacttttccatcggtgatgtcgttggtgaccggcttcgacttcccgttcgccgcaatgggagcgatacacaccgagaaccacatcacgcaataccggccgatcgcggtcaccgacgcggtgggcgtgcgggtgcgcgcggagaatctgcgcgaacaccgcaggggcctgctggtcgatctggtgaccaacgtcagcgtcggcaacgatgtcgcctggcaccaggtgacgacgttcctgcatcaacaacgcaccagcttgtccggcgaacccaaaccgccgccgcaaaaaaagcccaagctacccccgcccgccgcggtcctgcggatcaccccggcgaagatccgccgctatgccgccgtcggcggcgatcacaacccgatccacaccaacccgatcgcggcgaaactgttcggcttccccaccgtcatcgcgcacgggatgttcactgccgcggcggtattggcgaatatcgaagcccgttttccggacgcggtgcgctattcggttcggttcgccaagccggtgctgctgccggccaccgcgggactctacgtcgccgaaggcgatggcggctgggatctcacgctgcgcaatatggccaagggatacccccacctgaccgctaccgtgcggggtctatag

SEQ ID NO: 42 - DNA, 1323 bp, Mycobacterium Tuberculosis
gtggcccctgctgctaagaacacttcacagaccaggcggcgagtcgccgtactgggcggcaaccgcatcccgttcgccagatcggacggtgcctacgcggatgcgtccaaccaggacatgttcaccgcggcgctgagcggcttggtggaccgattcggactcgccggcgagcggctggacatggtggtgggcggtgcggtgctcaaacacagccgcgacttcaatctaatgcgcgaatgcgtgctgggctccgaactctcgccgtacacgccggcgttcgacctgcagcaggcctgcgggacgggcctgcaggccgcgatcgcggccgccgacggcattgccgccgggcggtatgaggtggccgccgctggcggggtggacaccacctcggacccgccgatcggcctgggcgacgacctgcgccgcaccctgctcaagctgcgccgatctaggtccaacgtgcaacgcctcaagctggtgggcacgctgccggccagcctgggcgtggagatccccgccaacagcgagccgcgcaccgggctgtcgatgggcgagcacgccgccgtcaccgccaagcagatgggcatcaaacgcgtagaccaggacgagctggccgccgccagccatcgcaatatggccgacgcctacgaccggggtttcttcgacgacctggtcagtccgtttttagggctgtaccgagacgacaatctgcggcctaactccagcgtcgagaaactggccacgctgcgtccggtcttcggagtgaaggccggtgacgcgacgatgacggccggcaattcgactccgctgaccgacggcgcctcggtggcattgctggccagcgaacagtgggcggaggcacactcgctggctccgctggcctatctcgtggatgccgagaccgccgcggtcgactatgtcaacggcaacgacggcctgttgatggcgccgacctacgcggtaccccggctgctggcccgtaacgggttgagcctgcaggacttcgacttctacgaaatccacgaggcgtttgcctccgtggtgctcgcgcatctggcggcgtgggagtccgaggagtactgcaagcggcggctgggcctggacgccgcgctggggtcgatcgatcggtccaagctcaacgtcaacgggtcgtcgttggccgccgggcaccccttcgcggcgaccggtgggcggattttggcgcagaccgccaagcagctcgccgagaagaaggcggcgaaaaaaggcggcggaccgctgcgcgggctgatttcgatctgcgcggccggcggccaaggtgtggccgcgattttggaggcctga

SEQ ID NO: 43 - DNA, 1485 bp, Mycobacterium Tuberculosis
atgtcgggtctgctggtcgcgggtacgacaagcgacgccggtaagagcgccgtgaccgcggggctgtgccgcgcgttggcccgacgcggtgtgcgggtggcgccgtttaaggcgcagaacatgtccaacaactcgatggtctgccgaggccccgacggcacgggcgtggagatcggtcgggcgcaatgggtgcaggcactcgcggctaggaccacgcccgaggcggcgatgaacccggtcttgctcaagccggccagtgatcaccgcagccacgtggtgttgatgggcaagccctggggcgaggtggcgtcgtcaagctggtgtgcggggcggcgagcgctcgccgaggccgcatgccgcgccttcgacgccctcgccgcccgctacgacgtcgttgtcgcggagggcgccggcagcccggccgaaatcaacctgcgcgcaggtgactacgtcaacatggggcttgcccgtcatgcgggactgccgaccatcgtcgtcggtgacatcgaccgcggcggggtgttcgctgcgttcctgggcaccgtcgcgttgctggctgccgaggaccaggcgctggtcgcggggtttgtggtcaataagtttcggggcgactccgacctgctggcgccaggtctgcgcgacctggaacgggtcaccgggcgcagggtgtacggcaccctgccgtggcaccccgacctctggctggactccgaagatgccctcgacctacagggccggcgcgcggcgggcaccggggcccgccgggtagccgtcgtgcgcctgccacgaatcagcaacttcaccgatgtcgacgcattgggtcttgagcccgacttggatgtcgtgttcgcttccgacccccgcgcgctggacgatgccgatctgatcgtgttgccgggcacccgggcaacgatcgccgatctagcctggctgagggcgcgagacctagatcgtgcgctgctggtgcatgttgcggcgggcaagccgctgctcggcatttgtggcgggttccagatgctgggccgggtgattcgcgacccgtacggcatcgaaggtccgggagggcaggtgaccgaggtcgagggcttgggtttgctcgacgtggagaccgcattttccccccacaaggtgctgcggctaccgcgcggcgaaggactcggtgtgcccgcgtcggggtacgagattcaccacggccggatcacccgcggtgacaccgccgaggagttcctcggcggcgcgcgcgacggaccggtgttcggcaccatgtggcacggctcgttggaaggcgacgccctgcgcgaggccttcctgcgagagacgctcggcctcgccccgtcgggctcatgcttcctggccgcacgcgagcgccgcctcgacctgctcggcgatctcgtcgaacgacacctcgacgtcgatgcgctgctcaacctggcccgccatggttgcccgccgaccttgccctttctcgctccgggcgcgccatga

SEQ ID NO: 44 - DNA, 1671 bp, Mycobacterium Tuberculosis
atgaccgccccgatctggatggcttcgcccccagaggtgcactcggcgctgctaagcagcgggcctgggcccggtccgctgctggtgtcggccgaggggtggcactcgttgagcatcgcctacgcggagacggccgacgagctggccgcgctgttggccgccgtacaggccggcacctgggacggcccgaccgccgcggtttacgtggccgcccataccccttatctggcgtggctggtgcaggccagcgctaacagcgcggccatggccacccggcaagaaaccgcggccaccgcctacggcaccgccttggccgcgatgccaacgttggccgagctgggcgccaaccacgccctccacggcgtgctgatggcgacgaacttcttcggcatcaacaccatcccgatcgcgctcaacgagtccgactacgcgcggatgtggatccaggccgccaccacgatggccagctatcaagcggtctcgaccgcggcggtggccgccgcaccgcagaccaccccagccccccagatcgtgaaagccaacgcgccgacagcggcttccgacgagccgaaccaagtccaggaatggctgcaatggttgcagaagatcgggtataccgacttctacaacaacgttatacaaccgttcatcaactggctgaccaacctcccctttttgcaagcgatgttttccggatttgatccgtggctgccctcgctgggtaatccgctaaccttcctaagcccggccaacattgcgttcgcccttggctaccccatggacatcggatcttatgtcgccttcctgtcgcaaaccttcgcattcatcggggcggatctggcggcggcgttcgcgtcgggcaatcccgcaactatcgcttttaccctgatgttcaccacggtcgaagccattggcacgatcatcaccgataccatcgcgctggttaaaacgctgctcgagcaaactcttgcgttgctcccggcggcgctgcccctgctagccgccccgctggcgccgttgacccttgcccctgcgagtgcagcaggcggcttcgcgggcttgtctgggctggcgggcctggttggcatcccgccatccgcgccgcccgtcatcccgccggtcgcggcgattgccccgagtatcccgacccccaccccaactccagccccagccccggcccccacggccgtgaccgcgccgacgcccccgcccgggccgccaccgccgccggtgaccgccccgccgccggtgaccggagccggcatacaaagcttcgggtacctggtgggtgacctgaactcggcggcgcaggccaggaaggccgtcggcaccggcgttcgaaagaagacgccggaacccgacagcgccgaggccccagcggccgcggcggcgcccgaggaacaggttcaaccgcagcggcgtcggcggccaaagatcaaacagctcggccgcggttacgaatacctggatttagaccccgaaaccggccacgacccgacgggttcgcctcaaggagcgggaaccctgggtttcgccggaacaacccacaaggccagtcccggacaagtcgcaggactgatcacgttacccaacgacgcgttcggcggcagcccacgcacgccaatgatgcccggaacctgggacaccgactcagcgacccgggtggagtga

SEQ ID NO: 45 - DNA, 1392 bp, Mycobacterium Tuberculosis
atggcactcaccaccgccccggcaatcgattatgcgctgccacgccagcaggatgagggcgatcactggatcgacgactggcgcccggaagacccggtgttctgggagacgatcggcaggccgatcgcccgccgtaacctgatcttctccatcttcgccgagcacgtcggcttcagcgtgtggatgctgtggagcatcgtggttgtccagatgaccgccgccgctcccgggcaccccgccgcgtccggctgggcgctgtccgccagccaggccctatgtttggtcgccgtccccagcggtgtcggggcgttcctccggctgccgtacaccttcgcgatcccgatctttggtggccgcaactggacgaccgtctcggcggcgctgctggtgatcccgtgcctgctgctggcttgggcggtgagccacccttccctgccgttcgcggtgttggtggtgatcgcggccaccgccggtttcggtggcggcaactttgcctcatcgatggccaacatctcgttcttctacccggagaaggacaagggttgggcgctgggcctgaacgcggccggaggcaacatcggggtggcggtggtgcagaagatcattccgcccatcgtggtcgccggcagtggggtggcactgtcgcgtgccggactgttcttcgtgcccttggccgtcgccgccgcggtgtgcgcattcctgtttatgaacaacctcacggaggccaaggccgatgtgaagccggtgtggcagtcgctgcggcatgccgacacctggatcatgtcgctgctgtacatcggcacctttgggtcgttcatcgggtattcggcggccttcccgacgttgctcaagaccgtgtttggccgtggtgacatcgcgttgggttgggccttcctcggcgcgggcatcggttccctggtccgtccgctgggcggcaagctcgccgaccggatcggcggtgcgcggatcaccgcggccagtttcgtcatgctggcggccggggcggctgcggcgttgtggtcggtgcagtcggtcaatctgccggtgttcttcgtcagcttcatgttcttgttcgttgccaccggcatcggcaatggttcgagctaccggatgatctcgaggatcttccaggtcaaaggcgaagtcgccggcggggatccggaaacgatggtgaacatgcgccgacaggccgccggagcgctgggcatcatctcctcgatcggcgcgttcggcgggtttgtggtgccgctggcctacgcctggtcgaaggtgcacttcggcaatatcgaacccgccctgcacttctacgtggcgttcttccttgccctgctcgtcgtcacctggtactgctacctgcgtagaaccacccccatgggccaggtgggggtgtag

SEQ ID NO: 46 - DNA, 1194 bp, Mycobacterium Tuberculosis
atgagccgcatggccgccccggtgtcgctggacgtgcacggacgccaggtcatcgtcacgcatccgggcagggtcgtcttccccgctcacaacgatcgaaagggctacaccaagttcgatctggtccgctattacctcgccgtggccgagggggcgatgcgcggggtggccggccggccgatgattctcaagcgtttcgtcaagggcatctccgccgaggcggtgtttcagaagcgcgcaccggcaaaccggccagactgggtggacgtggccgagctgcactatgcgtcgggccgctccgccgcggaggcggtcattcacgacgccgccgggctggcgtgggtgatcaacctggggtgtgtggatctcaatccgcatccggtgctcgccggcgacctcgatcatcccgacgagctgcgggtggacttggacccgatgcccggggtcgcgtggcagcgggtcgtcgaggtcgcgttggtggtccgggaggtgctggaggattacgggttgaccgcatggccgaagacgtccgggtcgcggggctttcacgtctatgcccggatcgcgccttgctggtcgtttccccaggtgcgcctggccgcccagaccgttgcgcgtgaggtcgaacggcgcctacccgacgcggcaaccagtcgttggtggaaggaagaacgcgagggcgtgttcgtcgacttcaaccagaacgccaaggaccgcacggtcgcgtcggcctactcggtgcgggccaccccggatgcccgggtgtccacgccgctgcactgggaggaggtgcccggctgcgacccggcggtgttcaccatggccaccgtgcccagccggttggccgacatcggtgacccctgggccgggatggatgacgcggttggccggctcgaccggctgttgatgctggccgaggaactgggtccgccgcagaaggcgcaatccgccaagccgctgatcgagatcgcccgcgccaagacgcgggccgaggcgatggcggcgttggacatctggcgcgaccggtatcccggcgccgcggctttgctgcggcccgccgatgtgctggtcgacggcatgcgcgggccgagttcgatctggtatcggatccggatcaacctgcagcacgtcccggccgaccagcgcccgccgcaggaggagctgatcgccgactacagcccgtggccgcggtga

SEQ ID NO: 47 - DNA, 1683 bp, Mycobacterium Tuberculosis
atgcctaacctcactgatctgcccgggcaggccgtctccaagctccagaagtccatcggacagtacgtcgcgcgcggcactgccgagttgcattacctgcggaagatcatcgaatcgggcgcgatcgggctggagccgccgctgaactacgccgcgctcgcagccgatatccgcaagtggggggaagtcggcatgctgccgtcgcacaatgccaggcgcgcccccaaccgggcggccgtcatcgacgaagaaggcacgctcacgttttccgaactcgacgaggccgcacacgcggtggccaatggcctactggccaagggtgtccgcgccggggacggcgtcgccatcttggcgcgcaaccaccgctggtttgtcatcgccaactacggggcggcccgagtgggggcccgcatcatcttgctcaacagcgagttctccggcccgcagatcaaagaggtgtcggaccgtgagggcgccaaggtgatcatctacgacgacgagtacaccaaggccgtcagcttggcccagccaccgttgggcaagctgcgggcgcttggtgtcaatcccgacgacgacaagccgtcgggcagctccgacgaaacgttggccgagctgattgcgcacagcagcaccgcgcccgccccgaaggcgagccgccgtgcgtcgatcatcattttgaccagcggcaccaccggcaccccgaagggggcgaaccgtaacacaccgccgacgctggctccgatcggcggcattttgtcgcacgtgccgttcaaggccggcgaggtgacgctgttgccgtcgccgatgttccatgcgctgggttacatgcacgccgcgctcgccatgttcctgggctcgacgctggtgctgcggcggcggttcaagcccgcgttggtgctggaagacatcgaaaagcacaaggcgacatccatggtcgttgtaccagtgatgctgtcgcggatcctcgaccagctggagaaaaccgaacccaagcccgacttgtcgagcttgaagatcgtgttcgtatccggatcgcaattgggtgccgagctggccacccgcgcgctgggggacctcggcccggtcatctacaacatgtacggctcgaccgaggtcgcgttcgccaccatcgccggccccaaggatctgcagttcaaccccagcacggtggggcccgtcgtcaagggggtgacggttaagatcctcgacgagaacggcaatgaggtgccgcagggtgccgttggccggatctttgtgggcaatgccttcccgttcgagggttacaccggcggcggtggcaagcagatcatcgacggcctgttgtcgtccggcgacgtcggctacttcgacgagcgcggcctgctgtatgtgagcggccgcgacgacgagatgatcgtctctggtggtgagaacgtgtttcccgccgaagtcgaggatctgatcagcgggcatcccgacgtggtggaggccgccgcgatcggcgtcgacgataaggagttcggtgcccggctgcgcgcgttcgtggtcaagaagccgggagctgacctcgacgaggacaccatcaagcagtacgtacgcgatcatcttgcccgctacaaggtgccgcgggaggtgatcttcctcgacgagctaccgcgcaaccccaccggcaaggtcctcaaacgtgagctacgcaagctgtag

SEQ ID NO: 48 - DNA, 921 bp, Mycobacterium Tuberculosis
atggcgatttcgctggtggctcaccagcccatcccccacgtcgagcgtcccatggccgacccaccccgtctccagctggccaggcgccggcgatcggcggccggccccggcggtaacgaggacagcttgatgggagtggcgctgctagccggcccggccaacgtgatcatggagttggcgatgccgggtgtcggctacggcgtgttggagagccgtgtcgaaagcggccggctggaccgccatccgatcaagcgggcgcgcaccacctttacctacgttgcggtggccgttgccggcagcgacgaccagaaggcggcctttcgtcgcgcggtgaataaggttcacgcgcaggtgtattcgactccggagagcccggtgtcctaccacgcgttcgatcccgaactacagctgtgggtggcggcatgcctctataagggcggcgtcgacgtctaccgcaccttcgtcggcgagatggacgacgaagaggccgaccatcattaccgcgcgggcatggcgatgggcaccacgttgcaggtgccgccgcagatgtggccaccggatcgggcggccttcgaccgctactggcggcaatcactggacagggtgcacatcgatgacgtcgttcgcgactacctgtatccgatcgtggcgctccgaattcgcgggatcgcactgccgggtccgctgcggcggctgtcggagggtatcgcgctgctgatcaccaccggtttcctgccgcagcggtttcgcgacgagatgcggttgccgtgggacgcgaccaagcagcggcgctttgacgcgctcatggccgtgctgcgcacggtgaatcgcctgatgccgcggtttgtccgggagttcccgttcaacctgatgctctgggacctggaccggcggatgaggcgcgggcgcccgctggtgtaa

SEQ ID NO: 49 - DNA, 2874 bp, Mycobacterium Tuberculosis
atgtcgtttgtgattgcggcgccagaggttatcgcggcagcggcaacggatttggccagtctcggatcgagcatcagcgcggcaaacgcagccgcggcggccaacaccacggcactgatggccgcgggcgccgacgaggtgtcgacagccatcgccgcgctgttcggcgcccacggccaggcctatcaggcgctcagcgcccaagcgcaggcgtttcatgcccagttcgtgcaggcattgacctccggtggcggcgcctatgcggccgccgaggccgccgcggtgtcgccgctgctggatccgatcaacgagttcttcctggcgaataccgggcgcccgttgatcggcaacggcgccaacggcgcccccggcaccggggccaatggcggggacggcggctggttaatcggcaacggcggcgccggaggatccggcgcggccggcgtcaacggcggcgccggcggcaacggcggcgccggcggcaacggcggcgccggcgggctcatcggcaacggcggcgccggcggcgctggcggggtcgccagcagtgggatcggcgggtccggcggagccggcggcaacgccatgctgttcggcgccggcggcgccggcggcgccggcggcggcgtagtagccctcacgggcggggccggcggcgccggcggggctggcggcaacgccggcctgctcttcggcgccgccggagtcggcggggccggcggattcacgaacggcagtgcactcggcggggcgggcggcgccggcggggccggcgggctgttcgccaccggcggggtcggcggatccggtggggccggcagctccggcggggccggtggggccggtggcgctggcgggctgttcggcgccggcggcaccggcgggcatggcgggttcgccgacagcagcttcggcggagtcggcggggccggcggggccggcgggctgttcggcgcaggcggggaaggcggcagcggcggacacagcctggtcgccggcggggacggcggggccggcggcaatgccggcatgctcgccctcggcgccgcgggcggcgccggcggaatcggtggggacggcggtactctcacggccggcggcataggcggcgccggcggcgccggcggcaacgctgggctgctcttcggctccggcggctccggcggcgccggcggattcggcttcgccgacggcgggcaaggcggccccgggggcaacgccggcacggtcttcggctccggcggcgccggcggcaacggcggagttggccagggcttcgccggcgggatcggtggggctggcggcacccccgggctgatcggtaacggcggcaacggcggtaacggtggcgccagcgcggtgaccggcggcaacggcgggatcggcggcaccggcgtgttgatcggcaatggcggtaacggcggtagcggtgggattggcgcgggcaaggccggagtgggcggcgtcagcgggctgctgctcggtctagacggattcaatgctcccgcgagcacctcgccactgcacaccctgcagcaaaatgtgctcaatgtggtgaacgagcccttccagacgctcaccggccgcccgctgatcggcaacggcgccaacgggactcctggaaccggggctgacggcggggccggcgggtggctgttcggcaacggcgccaacgggaccccggggaccggggctgccggcggggccggcgggtggttgttcggcaacggcggtaacggcgggcacggtgcgaccaacaccgccgccacggctacgggcggggccggcggggccggcgggatcttgttcggtaccggtggcaatggcgggaccggcgggatagccaccggtgctggagggatcggcggggccggcggcgccggtggggtctccttgctgatcggctccggcggcaccggcggcaacggtgggaactccataggcgtcgctggcatcggcggggccggcgggcgcggcggcgacgccggtttgctcttcggcgcggccggcaccggcggccacggcgccgctggcggtgtcccggccggcgtcggcggcgccggcggcaacggcggactgttcgccaacggcggagccggaggggccggcgggttcaacgcagccggcgggaacggcgggaacggcggactgttcggaactggcggcaccggcggggccggcacgaacttcggggccggtgggaacggcgggaacggcggactgttcggagccggcggcaccggcggcgccgccggctcgggagggtccgggatcaccaccggcggcggcgggcacggcggcaacgccggcctactctccctcggcgcctccggtggcgccggcggcagcggtggcgccagctcccttgccggcggggccggcggaaccggcgggaacggcgccttactcttcggcttccgcggcgccggcggcgccggcgggcacggcggggcagcacttaccagcatccagcaaggcggcgccggcggcgccggcgggaacggcggcttgctcttcggctccgccggcgccggcggcgccggcggcagcggtgccaacgctctaggcgccggtaccggcggcaccggcggtgacggtggccacgccggggtgttcggcaacggcggtgacgggggttgccggcgggtttggcgccggtaccggcggcagcggtggtgtcggcggcaacgccgtgctgatcggcaacggcggcaacggcggcaacgccggcaaagccggggccacgcccggtgccggcggcaccggcgggctgctgctcggcgagaacggactcaacggcttgccatagcaggcagacctgcgaccacacgcggcgttgagggcatcagttgctcaccgcagatgatgccgtag

SEQ ID NO: 50 - DNA, 1611 bp, Mycobacterium Tuberculosis
atgacgctgtggatggcctcgccgcccgaggtgcattcggcgttgctcagcagcgggccggggccgggctcggtgttgtcggcggccggggtgtggtcgtcgctgagcgccgaatacgccgcggtcgccgacgagctcatagggctgctgggcgccgtgcagaccggcgcttggcaggggcccagcgccgcggcttatgtggccgcccacgcgccgtacctcgcgtggttaatgcgggccagcgaaaccagcgcggaagcggccgcccggcacgagaccgtggccgcggcctacacgaccgcggtggcggccatgccgacgttggtcgagctggccgccaaccacacgcttcacggggtcttggtggcgacgaacttcttcggcatcaacaccatcccgatcgcgctcaacgaggccgactacgcgcggatgtggacgcaggccgccagcacgatggcgacctatcaagcggtcgccgaggccgcggtggcgtcggcaccgcagaccaccccggcgccgccgatcttggcagccgaagcggccgacgatgaccacgatcatgaccacgatcacgggggcgaaccgaccccgctggactatctggtcgcggagatattgcgcatcatcagcggtgggcgcctgatctgggatcccgccgagggcaccatgaacggaatcccgttcgaagattatacggacgcagcccaaccaatctggtgggttgttcgtgccatcgaattcagtaaggactttgaaacgtttgttcaggaactgtttgtcaatccggtggaggcatttcagttctactttgagcttctattgttcgactacccgacccacattgtgcagattgttgaggcgttgagccagtccccgcagttgctggcggtcgcactcggttccgtcatctccaacttgggtgcggtgaccgggttcgccgggctatccggcttggccggcatgcagccggcggctatcccggcgctagcacccgtcgcggcggccccgtcgacattgccggcggtcgcgatggccccgaccatggccgcgccgggcgcggcggttgcgtcggcagccgcgccggcgtccgcgccggcggccagcacggtggccagcgccacgccggcaccgccgccggcacccggcgccgccgggttcggctatccctacgccatcgctccgcccggcatcgggttcggctcggggatgagcgccagcgccagcgctcaacgcaaggcaccacagcccgatagtgcggcggcggcggcggccgcggcggccgtacgtgaccaagcgcgggcgcggcggcggcgccgtgtcacgcggcgcggatacggcgacgagtttatggatatgaacatcgacgtcgatccggactggggccctccgcccggcgaagacccagtcacatccacggtggcctcggatcggggtgccggacatctgggctttgccgggacggcccgcagggaggcggttgccgacgcggccgggatgaccacgctggctggcgatgatttcggcgacgggccaacgacgccaatggtgccgggttcgtgggatccggaccgggatgcgcctggctcggcggagcctggagatcggggctga

SEQ ID NO: 51 - DNA, 909 bp, Mycobacterium Tuberculosis
gtgcgtaccgaaggtgatagctgggacatcacaacgagtgtcggttcgaccgcgctgtttgtcgcgacggcgcgagcgctggaagcccagaagtccgacccgctggtcgtcgacccatatgcggaggcgttctgccgtgccgtcggcggttcgtgggccgatgtgctcgacggcaagcttcccgaccacaagttgaagagcaccgatttcggcgagcacttcgtcaacttccagggtgcccgcaccaagtatttcgacgagtatttccgtcgggccgccgccgccggcgcgcggcaggtggtcatcctggcggcggggctggactcgcgcgcgtaccggctgccttggcccgacgggaccacggtttttgagctggaccgcccgcaggtccttgatttcaagcgcgaggtgctcgccagccacggtgcccaaccgcgcgccctgcgccgcgagatcgccgtcgacctgcgtgacgattggccacaagccttgcgggacagtggtttcgatgcggctgcaccgtcggcatggattgccgaagggctgctgatctatctcccggccaccgcccaggagcggctattcaccggcatcgatgccctggccgggcgccgaagccacgtcgccgtcgaggatggtgccccaatggggccagacgaatatgcggctaaggtcgaagaggagcgcgccgcgatcgccgagggagccgaggagcacccgttttttcaactggtctacaacgagcgatgcgcgccggccgccgagtggttcggcgagcgaggttggaccgcggtcgctacgctgttgaacgactacctcgaagcggtgggtcgcccggtacccggaccggaatccgaagccgggccgatgttcgcccgcaacaccctggtcagtgccgcccgcgtctga

SEQ ID NO: 52 - DNA, 633 bp, Mycobacterium Tuberculosis
gtgggcgttcccgccaagaaaaaacagcagcagggggagaggtcacgagaatcgattctcgacgcgaccgaacgcctgatggcgaccaagggctacgcggcgacctcgatcagcgacatccgcgacgcgtgcgggctagcacccagctctatttactggcacttcggctccaaagagggcgtgctggccgccatgatggagcgcggcgcgcagcgcttctttgccgcgatacccacctgggatgaggcccatgggcccgtcgagcagcgatccgagcgccagctgaccgagctggtgagcctgcagtcgcagcatccggacttcctgcgcctgttctacctgctgtcgatggaacgaagtcaggatccggcggttgccgcggtggtgcgccgggtccgcaacaccgcgatcgcccgatttcgtgacagcatcacgcacctgctgccatcggacatcccgccgggcaaagccgatctcgtcgtcgcggagctgaccgcgttcgcggttgcgctgtcggacggcgtctatttcgccggccaccttgaaccggacacgaccgacgtcgagcgcatgtaccggcggctgcggcaagcgctcgaggccctgattcccgtcctcctggaggagacatga

SEQ ID NO: 53 - DNA, 717 bp, Mycobacterium Tuberculosis
atgactcgcccgcaagcgcttctcgctgtttcgctcgcttttgtcgcaaccgcggtgtatgccgtcatgtgggtggggcactcccaggattggggttggctgcatagtttcgattggtcgttgttgaacgcagcgcacgacatcgggataaagaaccctgcgtgggtgcgcttctgggatggtgtatccctgatcttgggcccagtcgtgctgcggccgctgggtttgctggccgcgatggtcgcactggcgaagcgcaagatacggatagcgttgttgctgttggcctgtttaccgctcaacgcgatcatgacgatcgcggccaaatccgtggcccaccgcccgcgaccggcgactgcgctggtatctgcccattcgacttcgtttccgtcagggcatgcgttggaggcgaccgcaagcgtactcgcgctgctaaccgtcctgttgcccatgctgcacagcaggtttactcggcacatcgccatcacggtgggcgcgctgtgcgtgttgacggtcggtgttgccagggtggcgttgaacgtgcatcatccgaccgacgttgttgccggctgggcgctggggtacctgtatttcctcgtgtgcctgtgcgtatttcgaccgccgtcgatattcggtgcccaacgcgcgtctcatgctttgtcgccgccagtggaggtgtcgagacaacccgaaccggaagtcgacacggcccgctaa

SEQ ID NO: 54 - DNA, 1230 bp, Mycobacterium Tuberculosis
atgagccaatcccggtacgcggggttgtcccgcagcgagctggcagttctgttacccgagctgttgttgatcggccagctgatcgaccgatcgggcatggcctggtgtatacaggcattcggccgccaggagatgctgcagatcgccatcgaggagtgggcgggcgccagcccgatctacaccaagcgcatgcaaaaggcgctgaacttcgagggcgacgacgtgcccaccatcttcaaggggctacagctcgacatcggcgcgccgccgcaattcatggacttccgtttcaccctgcacgaccgctggcacggcgagtttcacctcgaccactgcggtgcgctgctcgacgtggagccgatgggcgacgactacgtcgtcggcatgtgccacaccatcgaagatccgacgttcgacgccaccgcgatcgcgaccaacccgcgcgcgcaggtgcgccccatccaccggccgccccgcaagccggccgaccggcatccgcactgtgcgtggaccgtcatcatcgacgagtcctatcccgaggctgagggtattccggcgctggacgcggtccgtgaaaccaaagctgccacctgggaattagacaacgtcgatgcgtctgacgacgggctggtggactattcgggtccgctggtgtccgacctggacttcggggcgttctcgcattccgcactggtgcggatggccgatgaggtctgcctgcaaatgcacctgctgaatctgtcgttcgccattgccgtgcggaaacgggccaaagccgatgctcaactggccatttcggtgaacacccgccagttgatcggagtggccgggctgggcgcagaacgcattcaccgtgcgatggctttacccggcggaatcgaaggcgcgttaggtgtgctggagctacacccgctgctcaacccggccggttacgtgctggccgaaacgtcgccggaccgtctggtggtgcacaactcgccagcccacgccgacggcgcctggatttcgttgtgcacaccggcatccgtgcagccgttgcaggccatcgccaccgctgtagacccgcatctgaaggttcggatcagcgggacggacaccgactggaccgcggaactcatcgaggccgatgccccagcgagcgaactgccggaggtgttggtagccaaggtcagtcgcggatcggtcttccagttcgagccgaggcgctcactgccgttgaccgtgaaatga

SEQ ID NO: 55 - DNA, 2499 bp, Mycobacterium Tuberculosis
gtgcagcacagggggtgcaagaaccgtggccaagcatacgacgcatcggtgaccgattccctcaccgaggtcccgccggcagcacgccgtgccctcctggaactcgcgaatgccccgacggtaccggtcaaggtcctgatcaccgggggcatcggaacgggcaagaccaccgttctggctgccgcccgcgacacactgcgccgctcgggactcaccgtgctggcatgcccgccgccagacggcgaaccgccggagaccgcgctcgtcatcgacgacgcccagttgctcaccgataccgaattgctccggctcaccgagcgcgtggccgattcacggctgacggtggtggcggccgcggaagcccgcgagcaccaccgggcactacgagccctgacgatggcgctcgaacgggaccggccacgaatctcgctcggtccacttccggttgccgagcacctgcgagattgcaccgcgggactgccgttcctcattcatgcggtttccgccagggcacaggctcccgcgcaagcggccaaggtggccctcatcgagcggctgcgccgcctcgacgaacccactctggacaccctgctcatgatgtcgctaacccacgagctaggggtcagcgatgtagctgctgcacttgggatttcggtaacggatgcccgcggattggtcgatcgtgcgcacgccagcggactgatcgagtcgtcacacaccgcggcgtttctgcagtcagtccatgatgcgatcgctcagatcgtcggcaatgcacaccaccacgaggtcgaaacctcgctgttacgctcacaactcgatatctcgccggtgtcggcggagctagcgctgcgactggccgaacacgggctgcgcgacgagcggctggcggacatcctcacgcggtacgccgcggacacccgcgacgcttcggtccgttgcgcacggctgtaccgcgccgcggtccatgccggcgccaaaggattgacggtccgcctggccgacgcactggcccgcaccggcgactgtacggccgcggcaacactagccgacgatctgctcagctccccggatgccaccgaacgcgctgccgcggtgcgggttgcggccagcgtcgcggtccacgacggcaacacgggacacgcagccgagttgttcggctggctgggcccacacccggacacgatggtgagctcggccgccacgatcgtgttcgccgcgaacggcgacctggcgacggcgcgtgccaccctgcgactcaaggatgccggtccaccgacgatggcagcgcgttgcgcgcgcaacctcgccgaggggctgctgctgaccatggatcagccgtatccggtcgcgatggcaaaactgggccaagccattgccaccgaacaatcgctcagccaagtcattccggacagcccggcagcgctggttaccttggccgcgatacacgccggcgatccggtccgcgcccgcagtgtgatcgggcgtgccgtgcgagccggcgccgacccgctgttccagcgtcggcacctgctgctttccggctggatcaaaatgcaagaggggcaattgccgtcggcaagcgcggacgtcgcggcggccagcgccggcacgcacctgcaccggcgcgacgcgttgtgggccgcggcactgcaaaccgcgatctcgcgtcgcaccggcgatatcggtgcgctgcaacagcattggtatgcggcgatggaagcgctggccgagtattcgctcgatctgttcgccctgctgccacttggtgaactgtgggtcgcggccgcccgaatgcgccaggttgaccagctacaacacaccctggatcaggcgctcacgctgctggattcgctgggcaaccccgccctgtggtcgaactcactgcattgggctggagtgcacgctggaatcctcgccaattcgccggaatcggtggcaccgcacggacaggccctcggtgcaatggtcgcccacagcacgctcgcgcaggccctgtcggatgccggtcgcacctggctgcgggtcctggccgaaaacgtcgacgccgacgaggtcaccgcggcggcgcggtccctgtcacacgtcggcctgacgtcggatgcgacccgactggcaggtcaggccgcattgcaaacatccgacgcacgggtgtccggtgccatgctgcagttggcacgggatcttaagctgggcaacgatttcggcgagccccccagcggggccggcgacacggaaccagcttccggtaccccgccggcaccgcgccagccaccggcgggctcgccgctatccgatcgcgaacgcgaagtcgccgagctactgctactgggcatgccctatcgcgacattggcgcccggctgttcatctcagcgaagacggtcgagcaccacgtcgcccggatacgccagcggctgggcgctggctcccggtcggagatgttgtcgatgctgcgggccatgctggccccggagagcttaaccgcagatgagaggcgttga

SEQ ID NO: 56 - DNA, 540 bp, Mycobacterium Tuberculosis
gtggcaaactcgttgctcgactttgtcatctcgcttgtgcgcgacccggaagcggccgcacgttacgccgcgaaccccgagcggtcgatcgccgaagctcaccttaccgacgtgaccagagcggatgtgaacagcctgatcccggtggtgtcggattcgttgtcgatgtccgaacccatcggagccgctggcggggcacacgctggcgatcgtggcaacgtttgggcgagcggcgcggccacggctgcgcttgatgcgttcgccccacacgccgatgcgggtgttgtccaacagcacggtgcggtcggcagcgttctcaaccagccgaccccacccggaccgggcgtgacacccaccgatccgcgccccttccgagccggtccacatgagacgtcggcgctgctcacgagcgctgaaatacccgacacgaccagcgaggacgggggattgccgacagaccatccggctgtctggaaccacccggtcgttgacccacataccgtcgagcccgatcatcacggctacgacatccacggataa

SEQ ID NO: 57 - DNA, 1878 bp, Mycobacterium Tuberculosis
atggctcgtgcggtcgggatcgacctcgggaccaccaactccgtcgtctcggttctggaaggtggcgacccggtcgtcgtcgccaactccgagggctccaggaccaccccgtcaattgtcgcgttcgcccgcaacggtgaggtgctggtcggccagcccgccaagaaccaggcagtgaccaacgtcgatcgcaccgtgcgctcggtcaagcgacacatgggcagcgactggtccatagagattgacggcaagaaatacaccgcgccggagatcagcgcccgcattctgatgaagctgaagcgcgacgccgaggcctacctcggtgaggacattaccgacgcggttatcacgacgcccgcctacttcaatgacgcccagcgtcaggccaccaaggacgccggccagatcgccggcctcaacgtgctgcggatcgtcaacgagccgaccgcggccgcgctggcctacggcctcgacaagggcgagaaggagcagcgaatcctggtcttcgacttgggtggtggcactttcgacgtttccctgctggagatcggcgagggtgtggttgaggtccgtgccacttcgggtgacaaccacctcggcggcgacgactgggaccagcgggtcgtcgattggctggtggacaagttcaagggcaccagcggcatcgatctgaccaaggacaagatggcgatgcagcggctgcgggaagccgccgagaaggcaaagatcgagctgagttcgagtcagtccacctcgatcaacctgccctacatcaccgtcgacgccgacaagaacccgttgttcttagacgagcagctgacccgcgcggagttccaacggatcactcaggacctgctggaccgcactcgcaagccgttccagtcggtgatcgctgacaccggcatttcggtgtcggagatcgatcacgttgtgctcgtgggtggttcgacccggatgcccgcggtgaccgatctggtcaaggaactcaccggcggcaaggaacccaacaagggcgtcaaccccgatgaggttgtcgcggtgggagccgctctgcaggccggcgtcctcaagggcgaggtgaaagacgttctgctgcttgatgttaccccgctgagcctgggtatcgagaccaagggcggggtgatgaccaggctcatcgagcgcaacaccacgatccccaccaagcggtcggagactttcaccaccgccgacgacaaccaaccgtcggtgcagatccaggtctatcagggggagcgtgagatcgccgcgcacaacaagttgctcgggtccttcgagctgaccggcatcccgccggcgccgcgggggattccgcagatcgaggtcactttcgacatcgacgccaacggcattgtgcacgtcaccgccaaggacaagggcaccggcaaggagaacacgatccgaatccaggaaggctcgggcctgtccaaggaagacattgaccgcatgatcaaggacgccgaagcgcacgccgaggaggatcgcaagcgtcgcgaggaggccgatgttcgtaatcaagccgagacattggtctaccagacggagaagttcgtcaaagaacagcgtgaggccgagggtggttcgaaggtacctgaagacacgctgaacaaggttgatgccgcggtggcggaagcgaaggcggcacttggcggatcggatatttcggccatcaagtcggcgatggagaagctgggccaggagtcgcaggctctggggcaagcgatctacgaagcagctcaggctgcgtcacaggccactggcgctgcccaccccggcggcgagccgggcggtgcccaccccggctcggctgatgacgttgtggacgcggaggtggtcgacgacggccgggaggccaagtga

SEQ ID NO: 58 - DNA, 9903 bp, Mycobacterium Tuberculosis
atgagcttcgcggtgctgcccccggagatcaattcggcgcgcctgtacgtgggtgccgggttggcgccgatgctggacgcggcggccgcttgggatggactggccgacgaattgggttcggccgcggcctcgttttcggcggtgacggcggggctggcaggttcctcgtggctgggcgcggcgtcgacggcgatgacgggagcggccgccccctatctgggctggttgagcgcggcggcggcgcaggcccagcaggcggccacccaaacccggctggcggcggccgccttcgaggcagccctggcggcgacggtacatccggcgatcatctcggccaaccgggcactgttcgtgtcgctggtggtctcgaacctgctgggccaaaacgccccggcgatcgcggccaccgaggccgcctacgagcagatgtgggcccaggacgtggcggcgatgtttggctaccatgccggggcttcggcggccgtctcggcgttgacaccgttcggccaggcgctgccgaccgtggcgggcggcggtgcgctggtcagcgcggccgcggctcaggtgaccacgcgggtcttccgcaacctgggcttggcgaacgtcggcgagggcaacgtcggcaacggtaatgtcgggaacttcaatctcggctcggccaacatcggcaacggcaacatcggcagcggcaacatcggcagctccaacatcgggtttggcaacgtgggtcctgggttgaccgcagcgctgaacaacatcggtttcggcaacaccggcagcaacaacatcgggtttggcaacaccggcagcaacaacatcggcttcggcaataccggagacggcaaccgaggtatcgggctcacgggtagcggtttgttggggttcggcggcctgaactcgggcaccggcaacatcggtctgttcaactcgggcaccggaaacgtcggcatcggcaactcgggtaccgggaactggggcattggcaactcgggcaacagctacaacaccggttttggcaactccggcgacgccaacacgggcttcttcaactccggaatagccaacaccggcgtcggcaacgccggcaactacaacaccggtagctacaacccgggcaacagcaataccggcggcttcaacatgggccagtacaacacgggctacctgaacagcggcaactacaacaccggcttggcaaactccggcaatgtcaacaccggcgccttcattactggcaacttcaacaacggcttcttgtggcgcggcgaccaccaaggcctgattttcgggagccccggcttcttcaactcgaccagtgcgccgtcgtcgggattcttcaacagcggtgccggtagcgcgtccggcttcctgaactccggtgccaacaattctggcttcttcaactcttcgtcgggggccatcggtaactccggcctggcaaacgcgggcgtgctggtatcgggcgtgatcaactcgggcaacaccgtatcgggtttgttcaacatgagcctggtggccatcacaacgccggccttgatctcgggcttcttcaacaccggaagcaacatgtcgggatttttcggtggcccaccggtcttcaatctcggcctggcaaaccggggcgtcgtgaacattctcggcaacgccaacatcggcaattacaacattctcggcagcggaaacgtcggtgacttcaacatccttggcagcggcaacctcggcagccaaaacatcttgggcagcggcaacgtcggcagcttcaatatcggcagtggaaacatcggagtattcaatgtcggttccggaagcctgggaaactacaacatcggatccggaaacctcgggatctacaacatcggttttggaaacgtcggcgactacaacgtcggcttcgggaacgcgggcgacttcaaccaaggctttgccaacaccggcaacaacaacatcgggttcgccaacaccggcaacaacaacatcggcatcgggctgtccggcgacaaccagcagggcttcaatattgctagcggctggaactcgggcaccggcaacagcggcctgttcaattcgggcaccaataacgttggcatcttcaacgcgggcaccggaaacgtcggcatcgcaaactcgggcaccgggaactggggtatcgggaacccgggtaccgacaataccggcatcctcaatgctggcagctacaacacgggcatcctcaacgccggcgacttcaacacgggcttctacaacacgggcagctacaacaccggcggcttcaacgtcggtaacaccaacaccggcaacttcaacgtgggtgacaccaataccggcagctataacccgggtgacaccaacaccggcttcttcaatcccggcaacgtcaataccggcgctttcgacacgggcgacttcaacaatggcttcttggtggcgggcgataaccagggccagattgccatcgatctctcggtcaccactccattcatccccataaacgagcagatggtcattgacgtacacaacgtaatgaccttcggcggcaacatgatcacggtcaccgaggcctcgaccgttttcccccaaaccttctatctgagcggtttgttcttcttcggcccggtcaatctcagcgcatccacgctgaccgttccgacgatcaccctcaccatcggcggaccgacggtgaccgtccccatcagcattgtcggtgctctggagagccgcacgattaccttcctcaagatcgatccggcgccgggcatcggaaattcgaccaccaacccctcgtccggcttcttcaactcgggcaccggtggcacatctggcttccaaaacgtcggcggcggcagttcaggcgtctggaacagtggtttgagcagcgcgatagggaattcgggtttccagaacctcggctcgctgcagtcaggctgggcgaacctgggcaactccgtatcgggctttttcaacaccagtacggtgaacctctccacgccggccaatgtctcgggcctgaacaacatcggcaccaacctgtccggcgtgttccgcggtccgaccgggacgatcttcaacgcgggccttgccaacctgggccagttgaacatcggcagcgcaaatctcggcgacttcaacctgggcagcggaaacgtcggcagcttcaacgtcttctccggaaaccagggctcatacaatatcggtccggcgaacctgggtaactacaacatcggtttcgcgaacctgggtaactacaacatcggcttcggcaacgccggcgatttcaaccaaggctttgccaacaccggcaacaacaacatcggatttgccaacaccggcaacaacaacatcggcatcgggctgtccggcgacaaccagcagggcttcaattttgctggcggctggaactcaggcaccgcgaacatcggcttgttcaactccggcaccaacaacgtcggcatcggcaactcgggcaccggcaactggggtatcggcaactccggcagcggcaacaccggcatcggcaacaccggcagcactaacacgggcttcttcaacaccggcatcgtcaacaccggtgtcgccaacgcgggcagctacaacaccggctggtacaacaccggcgacaccaacaccggcatcgccaacctgggcgacttcaacacgggcttctacaacaccggcaatttcagtacgggctttgccaaccagggtgatatcgccaccggggctttcatcaccggcgacatgggcaacggcgccttctggcgcggcgaccagcagggcctattcagcgcgggctatcgggtccatgttcccgaaatacccgcacacgtcaccgtggaagttcccgtcaacatccccatcaccgccagcttcaccaacaccgtctacagcggcataacgcttgagcaaatcaacttcggtttcaccatcgacatcgcagggatccccctgctggccggtgcaatcagcaaggccgttctcccgcccatcaccgggaccggtcccgcgatcacggtcaacatcggcgaccctggcggttcgaccgcgatcaggatcccggccaccgcaagcgtcggtcccttcgatgtcacgttcgtcaacattgcggctaccacgggctttttcaacgccaccaccgatccgtcctcgggcttcttcaacggcggccccggaaccgtatcgggcatcgccaacatcggcgccaacatttccggcttccagaacgtcgcgaactccgcgacctcgggcttcaacaactacggctcgctgcaatcgggactggcgaacctgggcgataccgtctcgggcgtattcaacaccggcatcggggcaccggccaacgtctcgggcatgttcaacatcggcagcaacctcgcggggttcttccacgaccaggcgaccgggatgtcgatgttcaacctcggcctgggaaacatcggccaattcaacgtcggcttctccaacgtaggcgacagcaacgccggcttggcgaacatcggcagcttcaacctcggcagcggcaacctcggcagcttcaacgtcttcggcggaaaccagggctcatacaacatcggcccggcgaacctgggtaactacaacatcggcctaggcaacctgggcagctacaacttcggattcggcaacgccggcgacttcaacctgggcttcgccaacaccggcaacaacaacatcgggtttgccaacaccggcaacaacaacatcggtatcggcctgtccggcgacaaccagcagggcttcaattttgccggtggctggaactccggcagcggcaacagcggcctgttcaactctggcaccaacaacatcggtttgttcaactcgggcaccggcaacatcggcatcggcaactcgggcaccggaaactggggcatcgccaacaccggtgacaccaacaccggcatcttcaacaccggcgacgtcaacaccggcttgctcaacgccggcaacgtcaacaccggcatcttcaacaccggccattacaacaccggcagcttcaacgccggcagcttcaacacggccggcttcaacccgggtagctacaacacgggttatttgaacaccggcagctacaacaccggactggccaactcgggcgatgtcaacaccggcggcttcatcaccggcaattacagcaacgggttctggtggcggggcgattaccaaggcctggcggggatcagccaaacgatcaccgtgcccgacaccgccgttccggtgaaactgcacgtgccgatcttcctcgatatcccggtcaccggcacacttggcacgttcaccgttcatggcttcagattcccggagatcaccggcgatatcttcttgatcggcataccgttcaatgccgccacactcgatgcattcagtttcccgaacatctcgattgtccttcccaatatcggcatcaacctgggtagcgggccggacccgctgatcgatatcgccggcaccggcggtctattgccgatcaagattccactcatcgatataccggcggccccgggattcgggaactcgacgaccaccccgtcgtcgggattcttcaacgccggtaccggtaccgtgtcgggcgttggcaacgtgggcagcaatagttccggcttcttcaacctcacctctggaagctcgggaatctcgggcgtccagaacttcggcgagctgatctccggcgggttcaacttcggtaacactgtctccggccttgtcaatgcgagcacgcttgggctttcgatgccggccaatctctccggcggagggaatgtcggtgctacggtcgccggcttcgtcaacaacacccagatcctcaacctcgggtttggcaacgtaggcagcgggaatgtcggccacggcaatatcggcgactccaacgtcggcctcggaaacctcggcaacgcgaacgtcggccatggcaacatcggcagcttcaacgtcttctccggaaaccggggctcatacaatatcggcccggcgaacctgggtaactacaacatcggcctaggcaacctgggcagctacaacttcggattcggcaacgccggcgatttcaacctgggcttcgccaacagcggcagcaacaacatcgggtttgccaacaccggcaacaacaacatcggtatcgggctgtccggccacaatcaacaggggttcggctcctggaactccggtaccgccaacaccggcctgttcaactcgggcaccaacaacatcggtttgttcaactcgggcaccggaaacatcggcattggcaactcgggcatcggaaacaccgggatcggcaacccgggtgtcggcaacaccggcttggggaactcgggcaccggcaactggggcctgtggaacccaggcaccggcaatatgggcgtcgccaacgtgggcacctacaacaccggtggctacaacgtgggcagcaccaacaccggcatcgccaacgtgggcatcgccaacacgggcagctacaacaccggcagcaccaacaccggcagcttcaacgacggcgacttcaataccggcttctacaacaccggcgactacaacaccggcttctacaacaccggcgacgtgaacaccggcgccttcatcgggggcaacttcagcaacggcgccttctggcagagcgatcaccaaggccagtggggcgcacactacgcaatcactgttccccagatcccgctactgaactttagcctcaacattccggtcaacatccccatccatctcgacttcggtacccttgccgtcaacggcttccagattccggctatcaccctccgcgccctcggggtcacccacttcagcgtcggacccatcatcgttccgaggatcgccggcaccttaccggtgatcgatatcaacatcggcgaccccggcggttcatcctcgatacccatcacgatcaccagcggcgccggcccggtcgtcatcccgctactggacatcccgccggcccccggtttcggaaactcgaccaccggcccctcatcgggcttcttcaactccggcaccggcagctcgtctggattcggaaacgtcggcgccaacaattcgggcttctggaacaccgctttcgccggcataggaaactctggcttgcagaacttcggctcgctgcaatccggctgggcgaacttgggcaacaccgtctcgggcttctacaacaccagtgcggcggacttcgcgacgccggctaacctctcgggactctccaacgtcggcgccgacctgaccggcgtgctccgcggcccgaacgggtcgaccttcaacgcgggcctggcaaacctcggccaattcaacgtgggcagtgcaaacctcggcagtgcaaacctcggcagtgcaaacctcggcagtgcaaacctcggcaattcaaacgtcggcttcggcaacattggcaacgcgaacatcggcggcgcaaacatcggcgactttaacgtcgggatcgcaaacaccggtccggggctaacggcggctgtcaacaacatcggtatcggcaacaccggcaactacaacatcggtgtcggcaacaccggtaactacaacatcggcttcggcaacaccggcaacaacaacatcggcatcggcctgtccggcgacaaccagatcgggttcggcccgctgaacgccggcatcgccaacatgggcctgttcaacctgggcgacaacaactttggcatggccaacgcgggcaacttcaaccagggcattgccaacaccggcaacaacaacatcggcttgttcaacaccggcaacaacaacgtcggcatctggctgaccggcgacggcttgtccggcttcagctccctgaactccggcgccggcaacaccggtttcttcaactccggcaccgccaacaccggcttgttcaactccggcaccggcaacaccggcttgttcaactcgggcaccggcaacgtcggcatcggcaacatgggcaccggcggcttcggcgtcggcctatccggcgacagccaggtgggcatcggcggcaccaactcgggcagtttcaacatcggcttgtttaactcgggcaccggcaatgtcggcatcggcaactcgggcaccggcaacgtcggcatcggcaacaccggcaccggcaacaccggcatcggaaacagcggcaactacaacaccggcttgctcaacgcgggcctggtcaacaccggcatcgccaacccgggcaaccacaacaccggcctgttcaacatcggcaccttcaacaccggcatcgccaacccgggccactacaacaccggctcctacaacaccggtagctacaacaccggcatggcaaacgccggagactacggcaccggcgcgttcatcaccggcagcatgaacaacggcttgctctggcgcgccgaccggcagggcctgctggcggccaactacaccatcaccatcgagcgacctgccgcgttcctcaatgtcgacatcccggtcaacatccccatcaccggcgacatcaccaatgtctccatccccgccattacgttccccagaatcgacgccagcggaagcgtcgacataggcatcctcagtggcaccgtcttggccccggtcggtccgatcaccctgcatggcggggacgcgtcggccccgctggacacacccatcgaaattgacttcggcccctcgccggcgatcaacctcaacatcggcaagcccgacggctccaccgtgatcaacatcgtgggcggcgccggcgccggcccgatcagcattccgatcatcgacttgcggccagcgcccggcttcttcaacgccaccaccggcccgtcgtcgggcttcctcaactggggtgctggcagcgcatcgggcttgctgaacttcggcaacaactcgggcctctacaacttcgccactagcagcatgggaaattcgggcttccaaaactatgggtcgctgcagtcgggctgggcgaatttgggcaacagcatctcgggcatctacaacaccggcttgggagcaccggcaaatgtctcgggcttgctcaacatcggcaccaacctggctgggtggttgcagaacggcccgaccgagacgaccttcagcgtgggcttggccaacctcgggttctggaatctgggtagcgcaaacatcggcaactacaacctgggcagcgccaacatcggcgtctacaacctgggcagcgccaacatcggcgacttcaacctgggcagcgccaacatcggcgacttcaacctgggcagcgccaacatcggcagctccaacatcgggttcggcaacgtcggtccggggctgacggcggccatcggcaacatcggcttcggcaacaccggaaacggaaacatcggcatcggcaataccggcaccggcaacatcggcttcggcaacaccggaaacggaaacatcggcatcgggctgaccggcgacaccatgaccgggttcggcggctggaactcgggcaccggcaacatcgggctattcaactccggcaccggcaacatcggcttcggcaactccggcaccggcaactggggcatcggaaactccggtgactacaacaccggcatcggcaacaccggcagcaccaactccggcttcttcaacaccggcctggtcaacaccggcattggcaactccggtgactacaacaccggcctattcaacgccgggaacaccaacaccggcagcttcaaccccggcgactacaacaccggcggcttcaaccccggtaactacaacaccggctacttcaacccgggcaactccaacaccggcatcgccaactccggcgatgtcaacaccggcgccttcaattcgggcaactacagcaacggcttcttctggcggggcgactaccagggcctaggcggtttcgcctaccagagcgccgtttccgaaatcccgtggagctacgacaggttccaacattga

SEQ ID NO: 59 - DNA, 1299 bp, Mycobacterium Tuberculosis
atgccggcgatcgtcctcatcggcgcccaatggggcgacgagggcaagggtaaggccaccgacctgttgggtggccgcgtgcagtgggtggtgcgctatcaggggggcaacaacgccgggcacaccgtcgtcttgcctaccggcgagaatttcgcattgcatctcatcccgtcgggtgtgctgacgcccggggtcaccaacgttatcggcaacggcgtggtgatcgatcccggtgtcctgctcaatgagctgcggggactgcaagaccgcggcgtggacaccgccaagctgttgatctccgccgacgcccatctgctgatgccttaccacattgctatcgacaaggtcaccgagcgctatatgggcagcaagaagatcggcaccaccggccgtggtatcgggccgtgctaccaggacaagatcgcccgtattgggatccgggtcgccgatgtgctggacccggaacaattgacccacaaggtcgaggccgcgtgcgagttcaagaaccaagtgctggtcaagatctacaaccgcaaggccctggaccccgcgcaggtggtcgacgcgctgctggagcaggccgagggtttcaagcatcgcatcgccgacacccggctgctactcaatgctgccctggaggccggcgaaacggtgctgctggaaggctctcaaggcaccctgctcgatgtcgaccacggcacctacccgtatgtgacatcgtcgaatccgacggcgggtggcgcggccgtgggctctggtatcggcccgacccgcatcggcaccgtgctggggattctcaaggcctacaccactcgggtgggctccggcccgttccccaccgagctgttcgacgaacacggcgaatacctgtccaagactggccgcgagttcggtgtgaccaccggccggcgccggcgctgcggctggttcgacgccgtcattgcccgctacgccgcccgggtcaacggcatcaccgactacttcctgaccaagctcgacgtgctgtccagcctggaatcggtgccggtctgcgtcggatatgagatcgacggccggcgcacccgcgatatgccgatgacccagcgggatctttgccgcgccaagccggtttacgaggagctgccgggctggtgggaagacatctccggggcgcgcgagttcgacgacctgcccgccaaagcgcgtgattatgtgctgcgactggaacagcttgccggagcaccggtttcgtgcattggagtcggtccggggcgggaacagaccatcgtgcgccgggacgtcctgcaggatcgcccgtga

SEQ ID NO: 60 - DNA, 1383 bp, Mycobacterium Tuberculosis
gtgagcatccgccccgccgagaactcaacactcgacatccgccacgtcatcggtatcggcaccccgaaagccgtcgatttgtggctcgacgtcgtcaccgagctgccggatcgcgcccgcgaactcgggtcgttatccaaagccgaactcggaaagcttggcccactgctcgacggcaccaacgccgtcgagctattcgagtcgatcgacgacaagctggccgcagaggcactgcacgcgatggatccgtcgctggccgccaccttcctcgaggccctcgactccgaccacgccgccaacatcctgcgcgaattcaaggagcccaagcgggaggcgctgctgacgttgctaccgctggagcgggcgatggtgctgcgtggcttgttgagctggccggaggactgcgccgcggcccacatggtgcccgaaacgctgaccgtacgcccgaacatgacggtgtcgcaggccgtcgccagcgtgcgggaacgcgcctcgggcctgcgcagcgatgcacgaaccaccgcctacgtctatgtgacagacgccgactcccacctgctgggtgtgatcgcctttcgcgccctggtgctggccaatcccgaacagcgagtccgtgagctgatgggtgacgacctcatcgtcgtgtcgccgttgactgacaaggagctcgcggcgcagacaatcatgggccacaacctgatggcggttcccgtcgtcgatgccgacaaccggctactgggcatcatcgccgaagacgaagccatcgacattgccgaggaggaagcaaccgaagacgccgagcgccagggtgggtcggccccgctcgaggtgccctacctgcgggcgtcgccgtggctgctatggcgcaagcgggtcgtctggctcctggtactttttgctgccgaggcctacaccggcagcgtcctgcgggcgttctccgacgaaatggaggcggtgatagcgctcgcgttcttcatcccactgctgatcggcaccggcggcaacaccggcacccagatcgccaccactctggtccgcgcgatggccaccggtcaggtccggtttcgcgatgtgcctgcggtgttagccaaggagctgtcaaccggtgtgctggtcggcctcactatggccgccgccgcggtggtgcgcgcctggacattgggcgtgggcccgcaggtgaccctgacggtcgcgctgacggtggccgccatcgtggtgtggtcgtcgctggtggctgccgtccttccgccgctgctgaagaagttgcgcatcgacccggccatcgtttcggggccgatgatcgccaccatcgttgacggcacgggtctgctcatctacttcctggtcgcgcacctgacgctgaccgagctgcacggcttgtga

SEQ ID NO: 61 - DNA, 390 bp, Mycobacterium Tuberculosis
gtgcccaaagccgtcgaccgcgtcacgcgcgtcgccgcggatctggtggacagcgcggcggccgagggtgctcgtcagagccgttcggccaagcagcagctcgaccactgggcccgcgtcggtcgggcggtgtcgaaccagcacacggcgtcgcggcgccgcgtggaagctgcgctcgcggggcatctgccgatgacggacctgacgctggaggagggcgtggtgttcaacgccgagatctccgcagctatcgaggagcgcctgtcgcgaaccaactacggcgacgtgctcgccgcgcagggcatcaccacggtcgccctgaacgacgcgggcgacatcgtcgagcaccggccagacggcacctcggtcgtgctggcggccacgccgtga

SEQ ID NO: 62 - DNA, 897 bp, Mycobacterium Tuberculosis
gtgaccttcgcaagtcccgacgacgtgatccgccggttcgacgaacagaactacctgctggataccggcacggcgtcggcaatctatctggcggttacgctgggcaggccgctgttgttggagggtgagcccggtgttggcaagacaacagccgcgaaaacccttgcagtcgtgttggataccacgctgatccggctgcaatgctatgaagggctgacggccaacgaggcgctctacgactggaactaccaacgccagctattgtccatcaggctggccgaggcgcgcggcaagggtatctcagacatatcggaagcggatctgtacaccgaggcgtatctggtggaccggcccatcctgcggtgcgtgcggcaccgcggaccgacccctccagtgctgctcatcgatgaaatcgaccgggccgacgacgaattcgaggcgttactgctggagttccttggtgagtccgcggtgaccgttcccgagctgggcactttcctcgcggagtgcccgccgatcgcggtgctcacgtccaaccgcagccgtgacctgcacgacgcactgcggcggcgctgcctctaccactggatcgactacccggggccggaccgggcggccgcgatcgtgcgccgcacggtgcccggggctaccgcgccgttgatcgagaacgccactcaattcgtttgcactgcacgggatctcgatctggacaagccacccggtgtggccgagactatcgactgggtggcggctttggtggcactcggggtcgcagacctcaccgcagcggattcgagtcccgctctggccagccttggggccctggccaaaacgcccgacgaccgtacgcagattcgcgatgcgtaccaagcttttactgagtgcagccacgcatga

SEQ ID NO: 63 - DNA, 2400 bp, Mycobacterium Tuberculosis
atgacaacgatcgagtcacgccctccgtcgccggaagacctagccgacaacgctcagcagccgtgcgggcacggccggatgatgcgcaaagaggacccgcgattcatccgcgggcgcggaacctacgtcgacgacgtcgcgctgccgggcatgttgcatctggccatcctgcgttcgccgtatgcgcatgcccgcatcgtgcgcatcgatgtgactgccgcgcaggcacatccgaaagtcaaggccgtggtgaccggcgccgatctggccgccaagggcctggcttggatgccgacactagccaacgacgtacaagccgtgctggccaccgacaagacgcgcttccagggccaagaggtggcgttcgtggttgccgaggaccggtattcggcccgcgatgcatgcgagttggtcgacgtcgactacgaaccgcgggatcccgtcgtggatgcccgcacggcgctggacccgtcggcgccggtcatccgcaccgatctggagggaaagagcgacaatcacatcttcgactgggagaccggcgacgcggcggcgaccgaggcggtgttcgccaaggccgacgtcgttgtccagcaggagatcgtctacccgcgggtgcacccggcgccgatggaaacctgtggcgcggtggccgatctagatccggtcaccggaaagctgacgctgtggaccaccagccaggcgccgcacgcgcatcgcacgctatacgcgctggtggccgggttgcccgaacacaagattcgggtgatctcgcccgacatcggcggcggcttcggcaacaaggtgccgatctatcccggttatgtctgtgccattgtcgcgtcgctgctgctggacaagccggtcaaatggatggaggaccgcagcgagaacctgacgtccaccggattcgcccgcgactacatcatggtcggcgagattgccgccaaccgtgacggcaagatcctggcgatccggtccaatgtgctggccgaccatggtgcgtttaacgcccaggccgcgccggcgaagtacccagccgggttcttcggggtgttcaccggcagctacgacatcgaggccgcctactgtcacatgaccgcggtgtataccaacaaggcgcccggcggggtcgcctacgcgtgttcgttccgcatcaccgaagcggtctacttcgtcgagcggctggtggactgcctggccttcgagctgaagatggatccagccgagctgcgcttgcggaatctattgcggcccaaccagtttccgtatcagagcaagactggttgggtgtacgactcgggcgactacgagaccacaatgcgtaaggcgatgaacatgatcggctacgaggcgttacgcgccgaacaaaagcagcggcgagcgcgcggcgagctgatgggcatcgggatgtcatttttcaccgaggccgtgggcgccgggccgcgcaaggacatggacatcctcggcctgggcatggccgacggctgcgagctgcgcgtgcacccgacgggcaaagccgtgctgcggctttcggttcagacccagggccagggccacgagacgacgttcgcgcagatcgtcgccgaggagctggggattgcgcccgacgacatcgaggtggtgcacggcgacaccgaccagacaccgttcgggttgggcacctacggcagccggtccacacccgtctcgggtggtgccgcggcgctggtcgcccgcaaggtgcgcgacaaggccaagatcatcgcctcgggcatgctcgaggtttcggtcgccgacttacagtgggagaaagggaagttccacgtcaagggtgacccgtcggccgcggtgaccatcgccgacatcgcgatgcgcgcgcacggcgccggcgatctgcccgagggcatcgagggcgggctggatgccgaggtctgctacaacccgtcgaatctgacctacccgtacggcgcctacttctgtgtggtcgacatcgacccgggcaccgcggtggtgaaggtgcggcgctttttggccgtcgatgattgcggaacccggatcaacccgatgatcatcgagggtcaggtacacggcggcatcgtcgacggcatcggcatggcgctgatggagatgattgccttcgacgaggacggcaactgtctgggcggatcgttgatggactacctgatcccgaccgcgctcgaggtgccacacctagagaccgggcacaccgtgaccccgtcgccgcatcacccgatcggcgccaagggcatcggtgagtcggccacggtgggttccccgccggcggtggtgaacgcggtggtggatgcgttggcgccgttcggggttcggcacgccgacatgccgttgacgccgtcgcgggtctgggaggccatgcagggccgggccacaccaccgatctag

SEQ ID NO: 64 - DNA, 222 bp, Mycobacterium Tuberculosis
gtgtcgggccgctgggaggccgggaatgcggacggtaacggtggctccgcggggttgatcggcagcggcggggccggcggcgacggcggtagcggcggggccaccggcgccggtggcgaaggtggcgatgctggagcaagcgggtccataaacggcaacgccggcgaccccggcaacagcggagaacgcggcgcagtgggcaagcccggcgcacccggctga

SEQ ID NO: 65 - DNA, 216 bp, Mycobacterium Tuberculosis
atgagtgtgtacaaggtgatcgacatcatcgggaccagccccacatcctgggaacaggcggcggcggaggcggtccagcgggcgcgggatagcgtcgatgacatccgcgtcgctcgggtcattgagcaggacatggccgtggacagcgccggcaagatcacctaccgcatcaagctcgaagtgtcgttcaagatgaggccggcgcaaccgcgctag

SEQ ID NO: 66 - DNA, 720 bp, Mycobacterium Tuberculosis
atgactgagcccagacctgtcttcgctgtcgtgatcagcgccggcctatccgccatcccgatggtcggcggcccgctacaaaccgtgttcgacgccatcgaggaacgcacccggcaccgcgccgagacaaccacgcgcgagatatgcgagagcgtcggcggcgcggacaccgtgttgagccgcattgacaaaaatcccgaactcgagccgcttctcagccaggcgatcgaggccgccactcgcaccagtatggaggccaagcgccggctcctcgcgcaagctgccgccgccgcgctcgaggatgaccagaaggtcgagccggcatcactcatcgtggccacgctttcccaacttgagcccgtgcatatccatgcactcgttcggctggccaaagccgccaagtcctcaccggaccaggacgagatccagcgacgcgaggtgatgagggcggcgagtaaggtcgagcccgtgccggtgctagcggccctcattcaaaccggcgtcgcgatcgcgacaacaaccgtttggcacggcaacggcaccgggactccggcagaagaaagcggccacatccttatccacgacgtcagcgacttcggccaccgcctgctggcctatctcagggccgccgacgcaggtgccgagctcctcatcctcccctctggagggtctgcgccaaccggcgaccacccgacgccgcacccgtccacgtcgagatga

SEQ ID NO: 67 - DNA, 393 bp, Mycobacterium Tuberculosis
gtgcgggcgctcggctggctacgagaggaccgcaagccgctgctgaatgccaaattgctcgtgctcggtcatctggctttgaacgtctacgaccccgataacggttacggcgaagaggtgttggactttgagccgcggacggtgtggtggggatcggccaattggaccgtgcgggccgggtcacacttggaagttggctttgcatgcgacgacccaaccctcgtcgaagaagctacagcgtttgtcgctgacgtgatcgcgttctccgaaccgatcgacacgacctgtgccggtcccgaaccgaacctcgtgcaggtggagttcgacgacgccgcgatggctgaggcgatggaggagatggccgagcccgatgatgacggggaggattggtag

SEQ ID NO: 68 - DNA, 642 bp, Mycobacterium Tuberculosis
atgggagtcattgcccgcgttgtcggtgtcgccgcgtgcggtttgtccctggccgtgctggccgccgcgcccaccgcgggcgcggaacccaccggcgcgctgcccccgatgacatccagcggcagcggaccggtcatcggcgacggtgacgccgcgctgcgacagcggatctcacagcagctgtttagcttcggagatcccaccgtccaggaggttgacggctcggacgcggctcaattcatcacggccgcagccgctgtcgcggaccgcgatgtggcgtcggtgttcttgccgctgcagcgggtgttgggctgccaacagaacacagccggctcgggggccggcttcggggcgcgcgcctaccggcgaaccgacgggcaatggggaggcgcgatgctggtcgtcgccaagagcaccgtttccgacgtcgacgccctcaaggcctgcgtcaagtccggttggcgcaaggccacggcgggcacgccgacttcgatgtgcaacaacggttggacctacccgccgttcgccgacacccgccgcggcgaagagggctatttcgtcttgctggccggcacggcctcggacttctgcagtgcgcccaacgcgaactaccgaaccaccgcgagctcatggccgggctag

SEQ ID NO: 69 - DNA, 4620 bp, Mycobacterium Tuberculosis
atgccggtgcgtgctgtcgccacgggcttccgggcgaccgccacccttaccggcgcatcgatcactgccgcgacagcggtctcggcaaccctggccaagaccggggtcggaaccggtatgaaggtcgccatcatcccgctgcgcgcaggagccaaggcactttccggcgagctgtcccgcgagacactcggccggaactgttggcgtggcgagcgtcgcgcctggatcgaagtgcgcggcttgcgcagcggaggcgacgacgaacttgggcgcgtcgtgctcaacgcaatccaagcccaccccggggtcgggtcggccagcctgaactacccgttgtcccgtgtcgtcgtcgctatcgacgatcccgacacatcactgcgcgaactttgccgcattgtcgatgacgccgaaaaagccgaaagacaccgccacccagatcaagccgccgatcagctggcgcaatcaccggggagcctgccgggcgacggcgtgctgctggcggtcagagctgtaacggtagccgccaccgcggccgggctgggcttagcgctcggcggccgggcgctgcgctggccccgatttccgctcgtcatcgaggcagcggtggcggccgtggaccaccagccgttgctgcgccgcctactcgaggatcgaataggcacggaggcgaccgccaccgtccttgagctggccatggccgccgcacacacggtcacgctgtcgccggcggcgttgtcggtggatctgacgatccaggcgctgaaagccgcggaatgccgtgccggagccagagcctggcgccggcatgaaccacagctcgcgctgcacgccgacgaaccggccgaccaaccccaatccctttggccgcgtcccgcacggtcgacgcaacctgtccaacgcagcgtcgcgcgtttcgcgctgatccaagcgctgagcgcggtgctcgtgggcgccgggacccgcgacgcggacatggccgcgaccgcgacgctggtggccacccccaaagccagccggaccacgccggaggcgttcgccgcggcgctcggccaaggtttggctgatcagcacgcggtgttgccgttacggccggagagtttgcgccgattggatcgggtcgatgcgatcgtcatcgacccccgcgtgctgtgcaccgatgacctgcgcgtggcgcgcatccgcggttgcggcgcagacgagctgtccacagcgtggaatcgggcgcaactcgttttgacggagagtggcctgcgcccaggctggcaccgagtacccggtgtctcggccagcggttcggattcggcagtcgaggcacttttccgccccatgcacgaccggctggcctccgcggtggttgccgaggcacatcgcaccggggcggacctggtttcggtcgatgtcgacgccctgggcgagttgcgaccggtgttcgacgacatccggcccctcgacgacggtgccagcgggtccctcgacgaagccctagcccgtgcggtggccgagctgcgccaggcgggccgcaccgtcgcggtgttgtcatcggttggtaagcaagcgctttcggctgccgatgtggcgcttggtgtgctgccaccacctggagccggtgcaccgccctggtacgcagatgtcctgctgcccgatcttggagccgcctggagggtgctgcacgcgattccggcggccagggccgcacgccagcgaggtaacgaaatttccggtggtgcatcggctttgggagccctgttgatgctgccaggggtccgcggactggggcccggcccggtgaccaccggcgcggcggccggactgctctcgggatacctgctggcacgcaaggtcgtcgacgcgcaagcaccgcgaccggcacccgctcatgaatggcacgcaatgtcggtcgagcaagtccgcaaagctttgccgtcgccggacgagcaggcaccggcgaaggcaccgccttcgccgtatccggcccgtgcgctggccggtggcctgcacacggcgaagcgcggcgcacaaataacccaggcacccttgaacgcgctttggcagttgaccaaggccatgcgcgcggagttgtcggacccgttgacgcctatgctggcgcttggtgcaatggccagtgcggtgttgggttcgccggtggacgcggtgatggtcggttcggtgctcaccggaaactctattctcgcggccagccagcggctgcgtgccgaaagtcggctgaatcgcttgttggctcagcagattccacccgccaggaaggtgctggccggcgcggacgaccagccgaggtacatcgaagtccgcgccgaggagctgcgtcccggcgacatcatcgaggtgcggacccacgaggtggttcccgccgacgcccgggtgattgaggaggtcgacgtggaggtcgacgagtccgcgctcaccggtgagtcgctgtcggtgaccaaacaagtcgaacccacgccgggtgtcgacctgatcgaacgtcgctgcatgctctatgccgggacgaccgtcgtgtccggcaccgcggtcgcggtggtgaccgcggtgggtcctgacactcaggagcgccgcgcggccgagctcgtgtccggtgatctgtccagcgtcggcctgcagcatcagctgagtcggctcaccaaccaggcctggccggtcagcatgaccggcggcgcactggtcaccgggcttgggctgttgcgccggcggggcctacgccaagcggtggccagcggtatcgcagtcacagtggccgcagtgccggaagggatgccgctggtggccacactggcccagcaggcatccgcgcgacggctaagtcacttcggtgcgctggtccgcatcccgcgctcggtggaggcgctcggccgtgtcgacatggtctgcttcgacaagaccggaacgctcagcgagaaccgtttgcgggtggcgcaggtgcggccggtggcggggcactcgcgcgaggaagtgctgcgctgcgcggcgcacgctgcgccggcgtcgaacggcccgcaggtgcacgccaccgacgtcgcgatcgtgcaagctgcggcagcggctgccgccagtggcaccgacggtgccgaacccggcgccgcagaacccgccgcccacctgccatttcgctccggtaggtcgttttccgcctcggtgtccggcaccgagctgaccgtcaaaggtgcgcccgaagtggtgctggcggcgtgcgaaggcatcggctcgagcatggacgacgcggtcgctgaactggccgccaacggattgcgggtgatcgcggtggcccaccgccagctgaccgcgcaacaggcacagtcggtcgtggacgaccccgacgagatcgcgagattgtgccgcgacgagttgagtctggtggggtttcttgggttgtccgacaccccccgcgcccaggcggcggccctacttgcggacctgcacgagcacgatctggatatccggctgatcaccggtgatcacccgattaccgccgccgccatcgccgaggagctcggcatgcaagtgagccctgagcaggtcattagcggtgccgagtgggatgccctgtcacgcaaggaccaggagcgagcggtagccgagcgggtgatcttcgcccggatgacaccggagaacaaggtacagatcgtgcagacgctggaacacagcggccgggtgtgcgcaatggtcggcgacggctccaatgacgcggccgcgatccgcgccgccaccgtcggcatcggtgtcgtcgcccacggcagcgacccggcccgagtcgccgccgacctggtgttggtcgacggccggatagagtcattgctgcccgcaatcctggaaggacgccagctttggcagcgggtgcaagcggcagtgtctgtgctgctcggcggcaacgcgggcgaggtggcctttgccatcatcggcagcgctatcaccgggacctcgccgttgaacacccgtcagctgctgctggtgaacatgctgaccgacgcactgcccgcggcggcgctcgcggtcagcaagccaagcgacccggtaacgccggcaacccgcggtcccgatcaacgcgagctatggcgtgccgtcggtatccgcggggcgaccacggcggccgcggccaccgtggcctgggtgatggcggggttcaccggcttgccgcgccgcgcatccacggtggcgctggtggcgctggtggccgctcagttgggtcaaaccttggtggactcgcatgcctggctggttgtgctcaccgcactgggctcactggccgcgctggcaaccttgatcagcatccccgtcgtcagccagttgctcggctgcacccccctcgacccactcggctgggcgcaggcgacagcagccgcgactgctgcgaccgtcgccgtcgccgtgctgaaccgtgtgctgacgggtcgggacaaatcgggccagccgaacccgcaaccacccgagaccgatgcgctttcccgcgacgcgtcccccggtgcgccccccggacctcgacgacgccgacgcgccacagcacggcgtaaagctccagtaaaggcaccgtcagcaacaaggcaaacgacgaagccaaagggtccgccagcgcatcggtcctcgtcgacatacccccgacggtga

SEQ ID NO: 70 - DNA, 444 bp, Mycobacterium Tuberculosis
atgagtgtggtcggcgggacagttcgaaccgtggggcgaacggtgagtggtgcagcaacggcgaccacagcggccgcgggtgcggtgggtggcgccgccgtgagcggcatcgtcggcggtgtgaccggagccgccaaaggcattcagaaggggcttagcagcggcagcaagtcgaccgcggcagccgcgttggccatcggtgcgatcggtgtcgctggactcgtcgattggccgatcctgttggccgtgggcggcggagcgttgctattgcggaagctcaaccgcacccccgaggtggccgcaccgccggtgaaggcgaaacttgcgccggtgcccgacaagccggctgccgcaaaggaagcgccagccaaagcgagcaagacaacagccaggaagacgagcggtcgccgagcgggcaccgctgagctgcgcagcaccaactag

SEQ ID NO: 71 - DNA, 1131 bp, Mycobacterium Tuberculosis
ttgcctgcccgcaggtcggccgcccgaattgatttcgcaggctcaccgcggcccaccctcggtgtggagtgggagttcgcgctcgttgactcgcagacccgcgatctgagcaatgaagccaccgcggttatcgccgaaatcggcgaaaacccgcgggtccacaaggaattgctgcgcaacaccgtagagattgtcagcggtatctgcgaatgtaccgccgaggcaatgcaggatctgcgcgataccctgggccccgcccgtcagatcgtgcgcgaccgcgggatggagctgttctgcgcgggtacccaccccttcgcgcggtggtcggcccagaagctcaccgacgcgccgcggtacgcggagctgatcaaacgcacccagtggtggggccggcagatgctgatctggggtgtacacgtgcatgtcgggattcgctcggcgcacaaagtgatgccgatcatgacgtcgctgctcaactactacccgcatctgttggcgctctcggcctcatcaccctggtggggtggcgaagacaccgggtatgccagcaaccgggcgatgatgttccagcagttgcccaccgccgggctgccgtttcactttcagaggtgggcggagttcgaaggtttcgtgtacgaccagaagaagaccggcatcatcgaccatatggacgaaatccgttgggatataagaccctcaccccatctgggcaccctggaggtgcggatctgcgatggcgtgtccaacctacgagagctcggcgcgctggtcgcgctgacgcattgcctgatcgtcgatctggaccgccgcttggacgccggcgaaacgctaccgaccatgcctccctggcacgtccaggagaacaagtggcgtgccgcccgctacggcctggacgcggtgatcatcttggacgccgacagcaacgaacggctggttaccgatgacctcgcggatgtgctgacccggctggagccggtcgccaagtcgctgaactgtgccgacgagcttgccgcggtctccgatatctaccgcgatggcgcctcctaccagcggcagctgcgagtggcgcagcagcatgacggcgatttgcgcgcggtagttgacgcgctggttgccgagctggtgatttag

SEQ ID NO: 72 - DNA, 2187 bp, Mycobacterium Tuberculosis
gtgacccacccggacccggcccgccaactcacccttaccgcccggctgaacacctcggccgtcgactcacgccgcggcgtcgttcggttgcaccccaatgccattgctgcccttggcatccgcgagtgggacgcggtgtcgctgaccggctctcggacaaccgccgcggtcgccggcctggccgcggcagacaccgcggtcgggacggtgctgctcgatgacgtcacactgtccaatgcgggccttcgcgaaggcaccgaggtgatcgtcagcccggtcaccgtctacggagcgcgatcggtgacgctgagcggttcaacgctggccacccagtcggtgccgccggtcacgctgcggcaggccctactcggcaaggtgatgaccgtcggtgacgcggtctcgctgctgccccgcgatctaggccccggcacatccacgtcggctgccagccgcgcattggcagctgcggtcgggatcagttggacctcggagctgctgaccgttaccggcgtcgaccccgacgggccggtcagcgtgcagcccaactcgctggtcacctggggcgctggggtcccggccgcaatgggtacgtccacggccgggcaagtgagcatctcgagtccggagatccagatcgaagagctcaagggcgcccagccgcaggctgccaagctcaccgaatggctcaagcttgccctcgatgagccgcacctactacagaccttgggcgccggcaccaatttgggtgtgctggtgtcgggtccggccggggtgggcaaggcgacgctggtgcgcgcggtgtgcgacggccgaaggttggtgacactggatggtccggagattggagctctggccgccggagaccgggtcaaagccgtggcctcggcagtgcaggcggttcgccatgagggcggtgtgttgctgatcaccgatgccgacgccctgctgccagccgccgccgagccggtagcctcgctgatcctgtccgagctgcgtaccgcggtggccaccgccggtgtggtattgatcgccacctcagcacggcccgatcaactcgatgcccggctgcgttcccccgagttgtgcgaccgggagcttggcctgccgctgcccgacgcggccacccgcaaatcgctgctggaggcgctgctgaatccggttcctaccggagacctcaacctcgacgaaatcgcctcccgcacaccgggtttcgtcgtggccgacctggctgcgctggttcgcgaggcggcgctgcgggcagcgtctcgagccagtgccgacggccgaccaccgatgctgcaccaagacgacctcctcggtgcgttgaccgtcatccggccgctgtcccgctcggccagcgacgaagtcaccgtgggtgacgtgacgctcgacgatgtcggtgacatggccgcggccaaacaagcactgaccgaggcggtgctgtggccgctgcagcaccccgacaccttcgctcggctaggtgtcgaaccgccgcgcggggtgttgctgtacggcccgcccggctgcggcaagacctttgtggttcgtgccctggccagcaccggacagttgagcgtgcatgccgtcaaagggtcggagctgatggacaagtgggtgggctcctcggagaaggcagtccgcgagctattccggcgggcccgcgactccgcgccgtcactggtgttcctcgacgagctggacgctctggcgccacggcgcggtcagagcttcgactcgggcgtctccgaccgggtggtggccgcgctgctgactgagctcgacggtattgacccgctgcgggatgtcgtcatgctaggcgcgaccaaccggcccgatctgatagacccggcgctgctgcgcccggggcggctagaacggctggtgttcgttgaaccgcccgacgctgccgctcgccgcgaaatcctgcgcaccgctggcaagtcgatcccgctgagctccgacgtcgacctggacgaggtggcagccggactcgacggttatagtgccgccgactgtgtggcgctgctgcgcgaagccgcgcttaccgcgatgcggcgttccatcgatgccgccaacgtcaccgccgccgacctggcgaccgcgcgagaaaccgtgcgcgcgtcgctggatccgctgcaggtggcgtcgctgcgtaagttcggcaccaagggtgaccttcggtcctag

SEQ ID NO: 73 - DNA, 447 bp, Mycobacterium Tuberculosis
atgtctcggctgagttccatcctgcgtgccggcgcggcatttctggttctcggcatcgccgctgcgacatttccacaaagcgcggcagccgactccacggaagactttccaatacctcgccggatgatcgcaaccacctgcgacgccgaacaatatctggcggcggtgcgggataccagtccggtgtactaccagcggtacatgatcgacttcaacaaccatgcaaaccttcagcaagcgacgatcaacaaggcgcactggttcttctcgctgtcaccggcggagcgccgagactactccgaacacttttacaatggcgatccgctgacgtttgcctgggtcaatcacatgaaaatcttcttcaacaacaagggcgtcgtcgctaaagggaccgaggtgtgcaatggatacccagccggcgacatgtcggtgtggaactgggcctaa

SEQ ID NO: 74 - DNA, 915 bp, Mycobacterium Tuberculosis
atgccgacacccgatttccagacgctgctgtacacgacggccgggccggtggccaccatcacgctcaaccgcccggaacagctcaacaccatcgtcccgcccatgcccgacgagatcgaggccgctatcgggttggccgagcgcgaccaggacatcaaggtcatcgtgctgcgcggtgccggccgcgccttctccggcggttacgacttcggcggcggcttccagcattggggcgatgccatgatgaccgacggccgatgggatccgggcaaggatttcgccatggtcaccgcgcgggagaccggaccgacgcagaaattcatggccatctggcgggcgtccaaaccggtgatcgcgcaagtgcatggttggtgcgtcggcggggccagcgactacgcgctgtgtgccgacattgtgatcgccagcgaggacgccgtgatcgggactccgtatagccgcatgtggggagcctatttgaccgggatgtggctgtatcgactcagccttgccaaggtcaaatggcactcgctgacgggccggccgctgaccggtgtgcaggccgccgaagccgagctgatcaacgaggcggtgccgttcgagcggctcgaggctcgcgtcgccgagatcgccaccgagctggcacgaatcccgttgtcacagttgcaagcccagaaactgatcgtcaaccaggcctacgagaacatgggcctggcctccacccagctgctgggcggcattctcgacgggctgatgcgcaacacccccgacgcgctcgagttcatccggaccgcccaaacccagggtgtgcgagccgcggtcgagcgccgcgacggcccgttcggcgactacagccaagccccaccggaactgcgacccgaccccacgcacgtcatcactcctgatgggagcatgtag

SEQ ID NO: 75 - DNA, 861 bp, Mycobacterium Tuberculosis
gtgagcgatgcgatccagcgggtaggggttgtcggggccgggcagatggggtccggcatcgccgaggtctcggctcgcgccggcgtcgaagtgacggtgttcgagccggccgaggcgttgatcaccgcgggacgcaaccgcatcgtgaagtcgctggagcgggccgtcagcgccggcaaggtaaccgagcgcgagcgtgaccgcgccctcggcctgttgaccttcaccaccgacctcaacgacctatccgataggcaactggtgatcgaggccgttgtcgaggacgaggccgtcaagtccgagatcttcgccgagctcgaccgggtcgtcaccgatccggacgcggtgctggcgtcgaatacctccagcatcccgatcatgaaggtcgccgcggccaccaagcagccgcaacgggttcttggcctgcatttcttcaatccggtcccggtgctgccgctggtcgagttggtgcgcacgctggtcaccgacgaagccgccgccgcgcgcacggaggagtttgccagtactgtgctgggcaaacaggtcgtgcgttgctccgaccgctccggattcgtggtcaatgcgctcctggtgccgtatttgctgtcggcgattcggatggtcgaggccgggtttgccaccgtcgaagatgtcgacaaggccgttgttgcggggttatcgcacccgatgggtccgctgcggctttccgatcttgtcggcctagacaccctcaagctgatcgcggacaagatgttcgaagaattcaaagaaccgcactacgggccccctccgctgttgctgcgtatggttgaggcgggccagttgggaaagaaatcgggtcgaggtttctacacgtactga

SEQ ID NO: 76 - DNA, 447 bp, Mycobacterium Tuberculosis
atgaaagccctggtggccgtgtcggcggtggccgtcgtcgcactgctcggtgtatcttccgcccaagctgatcccgaggcggatcccggcgcaggtgaggccaactatggtggccccccaagttccccacgtcttgtcgatcacaccgaatgggcgcagtggggaagtctgcccagcctccgggtctacccgtcccaagttgggcgtacagcctcccgccgcctcgggatggccgctgccgacgcggcctgggccgaggttctcgcgctgtcaccggaggccgacactgccggcatgcgcgcgcagttcatctgccactggcagtacgccgaaatcagacaacccggcaaacccagctggaacctcgagccgtggcggccggtcgtcgacgactcggagatgttggcttccggctgcaatccgggcagccctgaagagtcgttttag

SEQ ID NO: 77 - DNA, 1110 bp, Mycobacterium Tuberculosis
atgaaacggagcggtgtcggttcgctctttgccggtgcgcatattgccgaggcggtcccgttggcgccgctgaccactttgcgtgtgggcccgatcgcccgacgtgtcatcacttgcaccagcgccgaacaggtggtggctgcgctgcggcacctggattcggcggccaagaccggagctgaccgcccgctggtgtttgctggtggctccaatttggtgatcgccgagaacctgaccgacctgaccgtggtgcggttggccaatagcggcatcaccatcgacggtaacttggtgcgggccgaggccggtgcggtcttcgatgacgtggtggttagggccatcgaacagggtctgggcggactggaatgcctgtctggcatcccaggatcggccggggcgacacccgtgcagaacgtgggggcgtatggcgcggaggtgtctgacaccatcactcgggttcggcttttggatcggtgcacgggtgaggtgcgttgggtatccgcgcgcgacctgcgcttcggctatcgcacgagcgtgctcaaacacgctgatgggcttgcggtgcccaccgtggtcttggaggtggagtttgcgctggatccgtcgggccgcagcgcaccgctgcgctacggcgagctgatcgccgcgctgaatgcgaccagcggcgagcgcgccgacccgcaagcggtccgcgaagcggtgctggccctgcgggcacgcaagggcatggtgctggacccgaccgaccatgacacctggagcgtgggatcgttcttcacaaacccggtggtcacccaggatgtttacgaacggctggccggtgacgcggccaccagaaaggacggtccggtcccgcactatcccgcgcccgacggcgtcaagctggccgccggctggctggtggaacgggccggcttcggcaagggctatccggatgccggcgccgccccatgccggctttccaccaaacatgcgctggcgctgacaaatcgtggcggggccaccgccgaagatgtggtgacgctggcgcgcgccgtgcgcgatggggtccatgatgtgtttggtatcacactaaaacccgaacccgtgctgatcggctgcatgttgtag

SEQ ID NO: 78 - DNA, 1356 bp, Mycobacterium Tuberculosis
gtggtcattcgtgtgctgtttcgcccggtatctttgatacccgtgaataactccagcaccccccagagtcaggggccgatcagtcggcgtctggcgttgacggcccttgggtttggggtgttggcaccgaacgttctggtcgcgtgcgccggcaaagtgaccaagctggccgagaagaggccgccaccggcgcctcgtctgactttccggcctgccgactctgccgccgacgtggtgccgatcgcgccgatcagcgtcgaggtcggtgacggctggtttcagcgggtcgcgctgaccaattcggcaggcaaggtcgtcgccggggcatacagccgggatcgcaccatctacacgatcaccgagccgctgggctacgacacgacctacacctggagcggttcggccgtcggccatgacggcaaggcggttccggtggcgggcaagttcaccaccgtggcacccgtcaagacgatcaacgcgggattccagctcgccgacggccagaccgtcgggatcgcggcgccggtgattattcagttcgattcaccgatcagcgacaaggccgccgtcgagcgggcactaaccgtgaccaccgacccgcctgtcgagggcggctgggcctggctgcccgacgaggcgcagggcgctcgcgtgcactggcgtcctcgggagtactacccggcgggtaccaccgtcgacgtcgacgccaagctgtatgggctgccgttcggcgacggcgcgtacggcgcgcaggatatgtcgttgcacttccagatcggtcgtcgtcaggtggtcaaggccgaagtctcgtcgcaccgcatccaagtcgtcaccgatgccggcgtcatcatggacttcccgtgcagctacggcgaggccgacttggcgcgcaacgtcacccgcaacggcatccacgtcgtcaccgagaaatactcggacttctacatgtccaacccggccgccggttacagccatatccacgaacgttgggcggtgcggatttccaacaacggcgagttcatccatgccaaccctatgagcgccggtgcccagggcaacagcaatgtcaccaacggctgtatcaacctgtcgacggagaacgccgaacagtactaccgcagcgcggtctacggtgacccggttgaggtgaccggcagttcgatccagctgtcctacgccgacggtgacatctgggactgggcggtggactgggacacctgggtgtcgatgtcggcgctaccgccaccggcggccaaaccggcggcgacgcaaatcccggtcaccgccccggtcacgccgtcggatgcccccaccccgtccggcacacccacgactactaacggaccgggtgggtag

SEQ ID NO: 79 - DNA, 552 bp, Mycobacterium Tuberculosis
gtgacttcctccttgccgaccgtgcaacgtgtgatccagaatgcgctcgaggtcagccagctgaagtactcccaacacccccgcccgggcggggcgccgcccgcgctgatcgtcgagctgccgggcgaacgcaagctcaagatcaacaccatcctgagcgtcggcgagcattcggtgcgtgtcgaggcgttcgtgtgtcgcaagcctgacgagaaccgcgaagacgtataccggttcctgctgcggcgcaaccgccgcctgtatggggtcgcgtacacgctggacaatgtcggcgacatctacctggtgggccagatggcgctgtccgcagtggacgccgacgaggttgaccgggtgttggggcaggtgttagaggtggtggattcggacttcaatgcgttgttggagttgggatttcggtcgtcgattcaacgagagtggcagtggcggttatctcgcggtgagtcgctgcagaacctgcaggccttcgctcacttacgcccgacgacgatgcagagcgcgcagcgcgatgagaaggagttgggcggttag

SEQ ID NO: 80 - DNA, 729 bp, Mycobacterium Tuberculosis
ttggttgagccaatgaaccagtcaagtgtctttcagccgccggatcggcagcgggtggatgagcggatcgcgacgacgatcgccgacgccatcctcgacggcgtcttcccgccgggctcgaccctgccgcccgagcgagacctggcagagcggctcggtgtcaaccgcacctcgctacgccagggtctggcgcgactgcaacagatgggcctgatcgaggtgcggcacggcagcggcagtgtggtccgtgaccccgaggggctcacccatcccgcggtggtcgaggcgctggtgcgcaaactgggccccgacttcctcgtcgagttgctggagatccgcgcggcgttaggcccgttgattggccgcctggcggccgcccggagcacgcccgaggatgccgaggcgttgtgtgcggcgctggaagtggtgcaacaggcggacacggccgcggcgcggcaggcagccgatcttgcctacttccgggtgctcatccacagcactcgcaaccgcgcattggggttgctctaccgctgggtggagcacgccttcggcggccgcgagcatgcgctcaccggggcctacgacgacgcggacccagtgttgaccgacctgcgggcgatcaacggggcggtgctggccggtgacccggcggccgctgccgcgaccgtcgaggcgtatctgaacgccagtgcgctgcgcatggtcaagtcctaccgcgaccgcgcttag

SEQ ID NO: 81 - DNA, 2907 bp, Mycobacterium Tuberculosis
atgagcgaaagacacgccgcactgacgtcactgccgcccattctgccgcggctgatccgccggtttgcggtggtgatcgtcctgctctggctgggcttcaccgcctttgtcaatctcgccgtaccgcaactggaagtggtcggaaaagcacactcggtatcgatgagccccagcgacgccgcatcgattcaggcgatcaagcgcgttggtcaggtgttcggtgagtttgattccgataacgcggtaacgatcgtgctggaaggcgaccagccactcggtggggacgcgcaccggttctatagcgatctgatgcggaagctttccgccgatacccgccatgtcgcgcacatccaggacttctggggggatccgctgacagcggcgggatcccaaagtgcggatgatcgggccgcctacgtcgtggtgtacctcgtcggtaacaacgaaaccgaagcgtatgactcggtccacgcggtgcggcacatggtggacaccacaccgccaccgcacggggtgaaggcctatgtcaccggtccggcagcactcaatgccgaccaggccgaggccggagacaaaagtatcgctaaggtcaccgcgatcacgagcatggtgatcgcagcaatgttgctagtgatctatcgctccgtaattaccgcggttctcgtcttgatcatggtcggcatcgacctcggcgcaatccgcggattcatcgccttgctcgccgaccacaacattttcagcctttcaacatttgcgaccaacctgctcgttctcatggcgattgcggcgagcacggactacgcgatattcatgctcggccgttaccacgaatcgcgctacgccggcgaggatcgggaaacggccttctacacgatgtttcacgggaccgcccacgtgatcttgggttcgggtttgaccattgccggcgccatgtattgcctcagctttgcccggcttccgtattttgaaacgctcggcgcgcccattgctatcggcatgctggtcgcggtcttggcggcgctcacgctcggcccggccgtactgaccgtgggcagcttcttcaagctgttcgatcccaagcggcggatgaacactcggcggtggcgccgggtgggaacggcaattgtgcgttggccggggccggtgctcgcggcgacatgcttggtcgcctccattggcttgctggccttgcccagttaccggacaacgtatgatctgcgcaagttcatgcccgccagcatgccgtccaatgtgggggatgcggcggctggtcgacgcttttcacgggctcggctgaaccctgaggtgctgttgatcgagactgaccacgatatgcgtaatccggtggacatgctggtgttggacaaggtagccaaaaatatctaccacagtcccggtattgaacaagtgaaagcgataacccggcccttgggaacaaccatcaagcacacttcgataccgttcatcatcagcatgcagggcgtgaatagtagcgagcaaatggaattcatgaaggaccgaattgatgacatactggtgcaggtggccgcgatgaatacctccatcgagacgatgcatcgcatgtatgcactcatgggcgaggtcattgacaacaccgtcgacatggatcatctcacgcatgatatgtcggacataacggctacgctaagagatcatctcgcggatttcgaggatttcttccggcctattcgcagctacttctactgggaaaaacattgtttcgacgttccgctctgctggtcgataagatcgatattcgatatgtttgacagtgtggaccagctgagcgaaaagctcgagtacctggtcaaggatatggatattctgattacactgttgccgcagatgcgcgcgcagatgccgccgatgatatctgcgatgacgacgatgcgggacatgatgcttatctggcatggcacgcttggcgcgttctataagcaacaggagaggaataacaaggaccccggcgcgatgggccgggtttttgacgccgcccagatcgatgattcgttctatctgccgcagtcggcttttgagaatccggatttcaagcgggggctgaagatgtttttgtctccggacggcaaggcagcccgctttgtcattgctctggagggagatcccgcaacgcccgagggcatctctcgggtcgagccgatcaagcgggaggctagagaggccataaagggaactccattgcagggcgctgcgatctatctgggtggcaccgcggcgacgttcaaggatattcgagagggcgccagatacgatctgctgatcgccggagtggcggcgataagcttgattttgatcatcatgatgatcatcacccgaagtgtggtagccgcagtggttatcgtgggtaccgtcgtgctttccatgggcgcctctttcgggctttccgtattggtctggcaggacattctgggtatcgagttgtactggatggtgttggcgatgtcggtgatcctgctcctggcggtgggatccgactacaatctgctgctgatttcccggttgaaagaggaaattggggccggattgaacaccggaattatccgtgccatggctggtaccgggggagtggtgacggctgccggcatggtgttcgccgttaccatgtcgttgtttgtgttcagcgatttgcgaattattggtcagatcggtaccaccatcggcctgggcttgctgttcgacaccctcgtcgtgcgctcgttcatgacaccgtccattgctgcgctgctgggacgctggttctggtggccgctacgggtgcgcccgcgcccggccagtcagatgcttcggccgttcgcgccgcgccgattggttcgcgccttgttgctgccgtccggccagcacccgtcagcgactggcgcccatgagtag

SEQ ID NO: 82 - DNA, 990 bp, Mycobacterium Tuberculosis
atgagcatgagttcctatccgcggcagcgaccgcgccggctccgctccaccgtcgcgatgcgccgtctggttgcgcaaacctcgttggagccaaggcatttggtgctgccgatgttcgttgccgacggcattgacgagccgcggccgattacctccatgccgggcgtggtacagcacacccgggattcgctacgtagggccgcggcagccgcggtggccgccggcgtgggtgggctgatgcttttcggcgtgccgcgcgaccaggacaaggacggtgtcggttcggcgggcatcgaccccgacgggatcctcaacgtcgcccttcgcgatctggccaaggacctgggtgaggccacggtgttgatggccgacacctgtctggacgagttcaccgaccacgggcactgcggtgtgctcgatgaccggggccgggtcgataacgacgccaccgtggcccgctatgtggaactggctgtggcgcaagcggaatcgggcgcccacgtggtcggacccagtgggatgatggatggccaggtagccgcgatccgggacggtttggacgccgccggctacatcgatgtggtgatcttggcctacgccgcgaagtttgcttcggcgttctacggcccgttccgcgaggcggtgagctctagcctgtccggggatcggcgcacctaccagcaggagccgggcaacgccgccgaggcgctgcgtgagatcgagctcgatctcgacgaaggcgccgacattgtgatggtcaaacccgcgatgggctacctcgatgtggtggcggccgcggcggacgtctcgccggtcccggtggccgcctatcaggtctcgggagagtacgcgatgattcgtgcggcggcggccaataattggatcgatgagcgtgccgcggtgctagagtcgctgaccggtatccggcgtgccggcgccgacatcgtgctcacctactgggcggtagacgcggcgggctggcttacgtga

SEQ ID NO: 83 - DNA, 609 bp, Mycobacterium Tuberculosis
atgcccgaggaaacccaagtccacgtggtgcgccacggtgaggtgcacaaccctaccggcatcctgtacgggcggctgcccggattccacctgtccgcaaccggcgcggcgcaggccgccgccgtcgccgacgcgctggccgaccgcgacatcgtcgcggtaatcgcatcgcccttgcagcgtgcccaggagaccgccgcgcccatcgccgcccggcatgaccttgcggtggagacagacccggatctgatcgaatcggccaacttcttcgagggccgccgcgtcggccccggtgacggggcatggcgcgacccgcgggtgtggtggcagctgcgtaacccgttcaccccgtcgtggggtgagccttacgtggatatcgctgcccgaatgacgaccgcggtggacaaggcacgtgtccgcggcgccggccatgaggtggtgtgcgtcagccatcagctgccggtgtggacgctgcggctgtatctgaccggtaagcgcctctggcacgatccgcgccgtcgggactgcgcactggcctcggtgacgtcgttgatctacgacggcgaccgcctggttgacgtggtgtattcgcagccggcggcgctttga

SEQ ID NO: 84 - DNA, 651 bp, Mycobacterium Tuberculosis
atgcagagcagagcgaccagaaggagcggcgctttgaccatgcgccggctggtgatcgccgcagcggtatcggcattgctgctcaccggctgttccgggcgcgacgccgtcgcccaaggcggcacgttcgaattcgtctcgcccggcggaaagaccgacatcttctacgatccgcctgccagccgcggccgcccgggcccactgtctgggccggagctggcggatccggcgcgcagtgtgtcgctggacgacttccctgggcaggtcgtcgtcgtcaacgtgtgggggcaatggtgtgggccgtgccgggccgaggtcagccaactacagcgggtgtatgacgccacccgaggtgcgggtgtgtcgttcctcgggatcgacgtgcgcgacaacaaccgccaggcgccccaggacttcatcaacgaccggcatgtgacgtacccgtcgatctatgacccggcgatgcgcaccttgatcgcattcggtggcaaataccccaccagcgtcattccgtccacgctggtgctggaccgtcagcaccgggtcgcggcggtgtttctgcgcgaattgctggctgcggacctgcagccggtggtcgagcgggtggccgaggaggagccgtcgggtcgggctccggtgggggcgcaatga

SEQ ID NO: 85 - DNA, 780 bp, Mycobacterium Tuberculosis
atgaccgggttcaccgagattgccgcggtggggccactgctggtggcggtgggggtatgtctgctggctggtctggtgtcgttcgcctcaccatgtgtggtgccgctggtgcccggctacctgtcgtatctggcggccgtcgttggggtggacgagcagctgccggccggcgtcgtcaaacccccggtggctgcccgctggcgggtcgccggatcggcggcgctgttcgtggcggggttcacgacggtgttcgtgctgggcaccgtcgccgtcttgggcatgaccaccacgctgatcacgaatcagctgctgctgcagcgggtcggaggcgtgctgatcgtcgtcatgggcctggtgttcgtggggttcatcggagccctgcagcgccaggcgaggttcacgccgcgccagttgacgagcgtagcgggggcgccggtgcttggcgcggtgttcgcgctcggctggacaccgtgcctggggccgacgctgaccggggtgatcaccgttgcctcggccaccgagggtgccagcgtggcgcgtgggatcgtgctggtgattgcctattgcctggggctggggattccgttcgtgcttttggcgttcggttcggcgtgggcggtggcgggcctgggctggctgcgccggcacaccagggccatccagatcttcggcggggcgctgctgatcgcggtcggtgccgcgctggtcaccggggtgtggaacgacgtcgtgtcgtggctgcgcgacgccttcgtttccgacgtgaggttgccgatttga

SEQ ID NO: 86 - DNA, 1218 bp, Mycobacterium Tuberculosis
gtgctggtgaccgagcatccgaggacgggcgtgggagcccccgatagcggcaacggcggcacggatcatccgaccgtgcagttgccgcccgtgccatccgtgggggcaccaccggctgcggccggtggtgaaacaccgactaggtcagttgcgggattccgcacccagcggctcgacccgacggcctacggcgcctactacagcggccccgatgagggcccggccagcccggctgaaaggccgccgtatcgtctcgagccggtgccccatacgccgtatccggaactggccaccaccacgctgctgaggccggtcaagccgccaccgtcggaaggctggcgtcggttgctctatctgctgtcgggtcggctgatcaacgccggggaaggccctcgggccgcgcacctcaacgacctggtcgctcaggtcaaccgcccgctgcgcggctgctaccggatcgcggtgttgtcgttgaaagggggtgtcggcaagaccacgatcaccgcgaccctgggggccacctttgccgacctgcgcggtgaccgggttgtcgcggtcgacgccaatcccgaccgcggcacactgagccaaaaggtcccgctcgagacgccggccacggtgcggcacctgctgcgcgacgccgacggcatcgagcgctacagcgacgttcgcggctacacatcgaagggacccagcgggctggaagtgctggcatcggacagtgatccggcctcctcggacgcattcagcgccgacgactacacccgcaccctggacattctggagcggttctacggcctggtgctcaccgactgcggtaccgggttgctgcactcggcgatgtcggcggttctgcctaggtccgacgtactggtcgtggtcagctcggggtccatcgacggcgcccgcagcgccgcggcgacgctggactggctgcaggcccacggccacgacgaccaggtgcgcaactcgatcgccgtcgtcaacgcggtgcggccgcgcgcgggcaaggtcgacgtgggcaaggtcgtcgagcacttctccaggcgttgccgtgcggtgcgcgtggtgccgttcgacccacacctcgaagaaggcgccgaaatcgcgctggatcggttgcggcgggagacccgcgaagcgctcaccgaactggcagcggtggtggccgctggattccccggcgacccgcggcgctgcaaaccgagcttcacctag

SEQ ID NO: 87 - DNA, 303 bp, Mycobacterium Tuberculosis
gtgaaccggtttctcacctcgatcgtcgcgtggttgcgcgcgggatatcccgagggcattccgccgaccgactcctttgcggtgctcgccctgctttgccgccggctgagccacgatgaggtcaaggcggtggctaacgaactgatgcgactcggtgacttcgaccagatcgacatcggcgtggtgatcacccatttcaccgacgagttgccgtcaccggaggatgttgagcgcgtccgggcgcggttggccgcccagggatggccactcgatgacgtccgcgaccgcgaggagcacgcatag

SEQ ID NO: 88 - DNA, 945 bp, Mycobacterium Tuberculosis
gtggtggctccagccggcgaacaaggacggagttcaacagccttgagtgacaacccttttgatgccaaggcgtggcggctcgtggacgggttcgacgatctgaccgacatcacctaccaccgccacgtcgacgatgccacggtgcgggtggcgttcaaccgccctgaagtgcgcaacgcatttcgcccgcacaccgtcgacgagctgtaccgggtgctcgaccatgcacgaatgtcgcccgacgtcggagtggtgctgctgaccggcaacgggccgtccccgaaggacggcggctgggcgttctgctccggcggcgaccaacgaattcgtgggcgcagcggttaccagtacgccagcggagacaccgcggacacggttgatgtcgcccgcgccggccggttgcacatcctggaggtgcagcggctgatccggttcatgcccaaggtggtcatttgtctggtcaatggctgggcggccggcgggggacacagcctgcacgtggtctgcgatctcaccctggccagccgcgagtacgcccgcttcaagcagaccgacgccgacgtcggcagcttcgatggcggttacggcagcgcatatctggcccgtcaggtcggccagaagtttgcccgcgagatcttcttcctaggccgcacctacaccgccgagcagatgcaccagatgggcgcggtcaacgcggtggccgaacacgccgagctggagacagtggggctgcagtgggcggccgagatcaacgcgaaatcgcctcaggcgcaacggatgctgaagttcgcgttcaacctgctcgacgacgggctggtgggtcagcaactgtttgccggtgaggccacccgcctggcctacatgaccgacgaggccgtcgaaggccgcgacgccttcctacagaagcgtccccccgactggagcccgtttccgcgctatttctaa

SEQ ID NO: 89 - DNA, 705 bp, Mycobacterium Tuberculosis
atgagtcgcgccgccttggacaaggatccccgcgacgtggcgtcgatgttcgatggcgtcgcccgcaagtatgacctgaccaataccgtgttgtccctgggccaggaccggtattggcggcgagccactcggtcggcgctgcggatcgggcccggccaaaaggtcctggacctggccgcgggcaccgccgtgtccaccgtagagctcaccaaatcgggcgcgtggtgtgtggctgccgatttttcggtcggcatgcttgcggcgggcgctgcgcgcaaggttcccaaggtcgccggtgacgccacccggctgccgtttggtgacgacgtgttcgatgcggtcaccatcagtttcgggctgcgtaacgtcgcaaaccagcaagcggcgctgcgggaaatggctcgtgtcacccggccgggcgggcggctactagtgtgcgaattctccacgcccaccaatgcgttgttcgccaccgcctacaaggaatacttgatgcgggcgctgccccgggtggcgcgggcggtgtctagcaaccccgaggcctacgagtacctcgcggagtcgatcagggcctggcccgaccaggcggtgctggcgcaccagatttcgcgggccgggtggtcgggggtgcggtggcgcaacctgaccggcggcatcgtagctctgcatgccggatacaaacccggcaaacaaaccccgcagtga

SEQ ID NO: 90 - DNA, 1332 bp, Mycobacterium Tuberculosis
atgaagctctttgacgatcgtggcgacgctggacgccagttggcgcaacgcctggcgcagctatccggcaaggccgtcgtcgtccttggcttgccgcgcggcggggtaccggtggcctttgaggtcgccaagtcactgcaagcgccactcgacgtcctggtcgtgcgcaagcttggcgtgccgttccaacccgaattggctttcggcgccatcggtgaggacggcgtgcgggtgctcaacgacgacgtcgtccgcgggacacacctcgatgctgccgccatggacgcggtcgaacgcaagcagctgatcgagctacaacgccgcgcggaacgcttccgccgcgggcgtgaccgcatcccgttgaccgggcggatcgcggtgatcgtcgatgacggcatcgccaccggagcgacggccaaggcggcgtgccaggtcgcccgggcgcacggtgcggacaaggtggtgctggcggtcccgatcggcccagacgacatcgtggcgagattcgccgggtacgccgatgaggtggtgtgtttggcgacgccggcgttgttcttcgccgtcgggcagggttaccgcaacttcacccagacctccgacgacgaggtggtggcgtttctggatcgtgctcaccgcgacttcgccgaggcaggtgcgatcgatgccgccgctgacccaccgcttcgcgatgaggaggtccaggtcgttgccggtccagtaccggtggcagggcacctgactgtccccgaaaaacccaggggaattgtggttttcgcacatggcagtggcagcagccggcacagtatccgcaatcggtacgttgcagaggtcttgaccggggccgggtttgcgacgctgttattcgacttgctcacgcccgaagaagaacgcaaccgcgccaacgtcttcgacattgagctgctcgcttcccgactcatcgacgtgaccggttggttggccacccagcccgacaccgcatcgctgccggtcggctacttcggcgccagcacgggagcgggtgcggcgctggtcgcggccgccgatccgcgcgtgaacgtgcgggcggtggtgtcccgcggcggccggcccgatctcgcgggtgattcgctggggagcgtggtggcaccgacgctgctgatcgtgggtggacgcgaccaggtggtcctcgagctgaaccaacgagcgcaagcggtaatacccgggaaatgccaactcaccgtggtccccggcgccacacacctattcgaagaaccaggcacgctggaacaggttgccaagctggcgtgcgattggttcatcgaccacttgtgcggcccaggcccaagcggctaa

SEQ ID NO: 91 - DNA, 342 bp, Mycobacterium Tuberculosis
atgggtgagcacgccatcaagcggcacatgcggcaacggaagcctacgaagcatcccctagcccagaaacggggcgcgcggattctggtcttcaccgacgatccccgcaggagcgtcctcatagtgcccggttgccacctggattccatgcgccgagaaaagaacgcgtactacttccaggacggcaatgcgttggttgggatggttgtctcgggcggcacggttgagtacgacgccgacgaccgcacatatgtcgtgcagctcaccgacggaaggcacaccactgagtcatctttcgaacactcatcgccgagtcgatcacctcaatccgatgacctatga

SEQ ID NO: 92 - DNA, 1167 bp, Mycobacterium Tuberculosis
gtgaaagtagcgattagcggtgccggcgtggcaggagcggcgctcgcccactggctgcagcgcaccggccacaccccgacagtgatcgagcgggcgccgaagttccgcaccggcggctacatgatcgacttctggggcgtcggctaccaggtggccaaacgaatgggcatcacggaccagatcgcagcggcgggttaccacatggaacacgtccgctccgtcggtcccaccggcaaggtcaaagccgacctgggcgtcgacgtctttcgccgcatggtcggcgacgacttcaccagcttgccgcgcggcgatctcgccgccgcgatctacacgacgatcgaagaccaagtggaaacgatcttcgacgacagcatcgccaccatcgacgagcaccgcgacggcgtccggctcaccttcgaaaggaccgccccgcgcgatttcgacctggtcatcggtgccgacggactgcactccaacgtgcgccggctggtcttcgggccggagcgggatttcgagcactacctgggctgcaaggtcgcggcctgcgtggtcgacggctaccggccccgcgacgagcgcagctatgtcctctacaacaccgtcgaccgacagctggcgcggttcgcgctgcgcggcgaccgcaccatgttcttgttcgtcttccgcgccgaacacgacaaccccggcgtggcacccaaagatgagctgcgcgaccaattcggcgacgtgggctgggaaagccgggacattctggccgccctcgacgacgtcgaggacctgtacttcgacgtggtcagccaaatccggatggaccgctggtcacgcggtcgggtgctgctgatcggcgacgcggccgggtgcatctcgctgctcggcggcgagggcaccggcctggcgatcaccgaggcctacgtgctggccggggagctcgcccgcgccgggggcgaccaccgtcgcgccttcgacgcctacgagaagcgcctgcgtcccttcatcgagggcaagcaagccagtgcggcgaagttcatctggtttttcgccacccgaacccgattcggcctgtggtttcgcaacgttgcgatgcgcacgatgaacttcggcccgctggcgacgctgttcgccggcagcgtgcgtgacgacttcgagctgcccgactacacctggtga

SEQ ID NO: 93 - DNA, 1305 bp, Mycobacterium Tuberculosis
atgctggaagtcgcggcagagccaacccggcgccggctgctacagctcctggcaccgggtgaacgcaccgttacccagcttgcgtcgcagttcacggtcacccgttcggcgatatcgcagcacctcggcatgctcgccgaagcgggattggttaccgcccgcaaacagggccgggaacggtactaccggctcgatgagcgcggggtgctgcggcttcgtgcgctcatggagtccttctggagcgacgagctggaccgtcttgtcgccgatgccgcccactacccgccgtcacaaggagactgtgccatgccgttcgagaaagcggtcgtcgtgcccttggatccgaccagcaccttcgcgctcatcacccagcccgacaggcttcggcgctggatggccgtcgccgcgcgtatcgagctgcgcaccggtggcgcttatcgctggacggtgactccggggcatagcgcggccggcaccgtcatcgacgtcgaccccggcaagcgggtggtcttcacctggggttgggaggaccacggcgaccccccgccgggcgggtcgacggtgaccatcacgctgaccccggtcgacggcggcaccgaggtccggctggtccacgacgggctgaccgcgcagcaggccgcccggcacgccaaagggtggaaccacttcctggaccggctggtcgtcgccggccaacgcggtgacgccggtcccgacgaatgggccgcagcgcccgatccgctcgacgaattatcttgtgccgaagcaacattggccgttcttcagcacgtactgcgcgggataggcgcctctgacctgaccaggcagacaccgtgtacggaatatgacgtttcgcaactggcggatcatttgctgcgctcgctggcgatcatcggcgctgcggcgggcgcgcagctggcgccccgcgatgtggacgcgccactggaaacccaggtggccgacgcggcgcaggccgtgatggaagcctggcggcggcgtggcttggcgggcacggtggagctgaactcgaaccaggtgcctgcgacggtgccggtcggcatcctgtgcctagaatttctggtccacgcttgggatttcgcgattgccaccggttctcaggtgatcgcgtccgagccggtgtcggagtacgtactggcggtggccggcaaggtcatcaccccggcaacccgtaactccgcgggcttcgccgcgccggcggcggtcggttcctttgccccagtcctcgatcgcctcatcgccttcaccggccgccagccgaccgcaggccacgtgtccgccacctaa

SEQ ID NO: 94 - DNA, 2634 bp, Mycobacterium Tuberculosis
atgcgggcacgcaggttgcgcagagccctggccgcgctcttggcggtggcgggtctgtttgttccgttcattgttggcgtgcccacggcctacgacggtgagccggtgttcgtcgccattccggtcgagcatgtcaatacgctcatcggcaccggcacgggagccgcgatagtgggggagatcaacaactttcccggcgcctcggtgccgttcggcatggtgcagtactcgccggacaccgtcgacaactacgccggctacgactacgacaacccgcattccaccggattcagcatgacgcacgcgtcggtgggctgcccggcgttcggcgacatctcgatgttgcccacgaccaccccgctcggctcgcagccgtggagcgcctgggaggagatcgcccacgacgacaccgaggtcggcgtgcccggctactacaccgtacggttccccggtaccggggtgatcgccgagctcaccgccaccacccgcacgggcgtcggccggtttcgctacccccgcaatgggtggccggcgctgtttcacgtgcgctccggcgcatcgttggcgggcaactacgccgcgacactgcagatcgaggacaacaccacaatcaccggctcggcgaccagcggcgggttctgcggcaagaagaacctgtacacggtgtacttcgccatgaagttcagccagccgttcagctcgtatggcacctgggacggctacgcggtctatcccggttcacacagcatgaattcgagttacagcggggggtatgtcgggtttccggccggctcggtgctcgaggtgcggaccgccctgtcctatgtgagcgtggacggggcgcgagccaacctggacgccgaaggcggagcaagcttcgacgacatccgtgcggcgacatcgagcgaatggaacgccgcgctatcgcgaatcgcggtggccggcagggggcctggcgacgtggacaccttctacacttgtctttaccggtcactgttgcaccccaacacctttaacgacgtggacggacgttacatcggattcgacggtgtcatccacagcgttgccagtgggcacacccactacgccaatttctccgactgggacacctaccgcagcctcgccccactgcagggactgttgttcccgcaacgggccagcgacatgatccagtcgttggtgaccgacgcggagcagagtggtgcgtatccgcgttgggcgctggcgaattccgcaaccggcatgatgagcggagacagtgtggtaccgctcatcgtaaacctctacgccttcggcgccagggatttcgacctcaaatccgcgctgcactacatggtgaatgcagcgacccagggcggtgtcggacttgacggtttcctggagcggccgggaatcgccgcctatctgaggctcggctatggaccacaaacggcggaattccgcgccaacggtcgtatcgccggcgcctcggtcacgctggagtggtcggtcgatgactttgccatctcccgattcgctgattcgttgggcgataccgcaactgccgccgtcttccagaaccggtcgcagtattggcagaacctgttcaatcccaccaccggctatatctcgccccggagcgcggccggtttcttccccgacggtcccgggttcgtggcatacccctcgggctttgggcaggacggatacgacgagggcaacgccgaacaatacctgtggtgggtgccgcataacgtggccggtttggtgaccgcgcttggtggccgcacggccgtcgtcaagcggctcgaccgctttaccaaaaagctcaacgtcggccccaacgaaccctatctgtgggccggtaacgagcccggtttcggggtgccctggctgtacaactacatcggccaaccgtggaaaacccagcggacggtcgaccgggtccgcgggctgttcggcccgacacctggcggtgcgccgggcaacgacgacctcggcgccctgtccagctggtatgtctgggctgcccttggcctgtatccgagcaccccgggaaccaccatcctgaccgtgaacacaccgcttttcgatcgcgccgtgatcgcgctccccaccggaaagtccattcagatcaccgcgccgggcgcatccgggcggaaccgcctgaagtacatcgacggcctgaccatcgaccgccaaccgagcaaccagacgtttcttccggagtcgatcgtgcgcaccggaggcgacctgaccttctcgctcgccggcacacccaacaaggtctggggaaccgcggcgtctgccgcgccgccgtcattcggtgcgggcagctcggcggtgacggtaaatatcgcccggcccatcatcgggatcgtgccgggagcgaccgggaccgtgaccgtcgacgcgcaacggatgatcgacggcgtcgacgactacactgtcaccccaacgtcctacgttgttgggattgcggcggaaccgttatccgggcaattcgacgatgacggagccgtgagcgcgtcggtcgcgatcaccgtagctcgatcggtgccgtcggggtattacccgatctatgtcaccaccagcgccggggatagtgcccggacattgatcgtgctggtcgtggtcgccgaggcggtggaatga

SEQ ID NO: 95 - DNA, 798 bp, Mycobacterium Tuberculosis
atgaccacccacgccgtgatcatcacctatctccgcgaccagacgcagcccgccgtcgatgcgatcggcgggttctaccggacatgcgtactgactggcaaggcgctggttcggcggcccttccattggcgtgaggcgatcgagcagggctggttcattaccagcgtctcgttgctgccaaccctggcggtgtcgattccgttgaccgtgttgatcatcttcacgctcaatatcctgctggccgagttcggcgccgccgacatctccggcgccggcgcggcgctaggcgcggtcacccagctgggcccgctgaccaccgtgttggtgattgccggcgctggagccacagcgatctgcgccgacctgggtgcccgcaccatccgggaagagatcgatgcgatggaggtgctgggcatcgaccccatccaccggctggtggtgcctcgggtcgttgccgcgaccatcgtcgccgcactgcttaacggcgcggtgataaccattggcctggttggtggtttcgtcttcagtgtcttcatccaacacgtctcggccggcgcctacgtgggcacgctcaccttggtcaccggtctacccgaggtgatcatctcggtggtcaagtcggcgacgttcggcctgatcgctggcctagtcggctgttaccgcgggctgaccacgaaaggcggccccaagggagttggaaccgccgtcaacgaaaccctggtgctgtgcgtgatcgcgctgttcgcgaccaatgtggtgttgaccacgatcggcgtgcggttcgggacgggacactag

SEQ ID NO: 96 - DNA, 1236 bp, Mycobacterium Tuberculosis
atgggagtcgtcgaacgcgcgatcgcgccctcggtgctggccgcgctcgccgacaccccggtcgtcgttgtcaacggcgcgcgtcaggtcggcaaaacaacactggtcgcgcgacttgactatccgggatccagcgaagtcgtctcgcttgacgacgtcgccaaccgcgacgccgcccgcgacgatccccgcgcattcgtatcccggccggtggacacgctcgtcatcgacgaagcccagctcgagccggggctgtttcgggcgatcaaggcagaggtcgaccgggatcgcaggccgggcaggttcctgctcacgggttcagcgaggctgctctcggctcctgacatggccgacgcgctcgtcgggcgggtcgaaatcatcgaactctggccgttctcgcaaggtgagcgggccggaatcgcggacggtttcgtcgatgcgctgttcaccgcaccacgcgagctgatccacggctccgatatgcgccgcgccgatctggtcgacaggatcgccaccggaggcttcccggacatcgtcgcccgatcgccgtcgaggcgtcgcgcgtggttcgacaactatctcacgacggcgacgcagtcggtgatccgcgagatttcgccgatcgagcggcttgccgaaatgccgcgtgtgcttcggctctgcgccgcgcgtaccggcgccgagctcaacgtgagcgcactggcgaacgacctgtcgatcccggctcgcaccaccgctggctatctggccctgctggaagcggcgttccttatccaccgggtgccggcctggtcgaccaacctgagccgcaaggtgattcgccgaccgaaactggtggtctcggacagtggcctggcgtgtcacctgctcggcgttaccggtgcgacgctggatcgccccggccgtccactcggcccgctactggagactttcgtggcgaacgagattcgcaaacagctcacctggtcgaccgaacggccgagtctgtggcattttcgcgaccgcggcggcgccgaggtcgatctggtgctcgaacatcccgatggtcgggtctgcggcatcgaggtcaaggcgaccagcacgccgcgagccgaggacctgcgtggcctacgttatctggccgagcggctcgatgatcgatttcagttcggcgtgctgctcaccgccgcgccggaagccaccccgttcggcccaacgctcgcggcgttacccgttagcacgctctgggccggctaa

SEQ ID NO: 97 - DNA, 507 bp, Mycobacterium Tuberculosis
gtgccgatcactcccctgctgcacgagagcgtggcccgcttcgccgctactggagcggacatcaccacacgcgcggaaccggacctgttcgtctcgatcgatccggaccacctgcgccgaatcctcaccgccgtgctcgacaacgccatcacccacggggacggtgaaatcgctgtcaccgcgcacgcccgcgacggtgcagtcgacatcggcgtccgcgaccacggccccggattcgccgaccactttcttcccgtcgccttcgaccgattcacccgcgccgacaccgcccgcggcggtcgcggcagcggcctcggcctggccatcgtcgccgccctcaccaccacccacggcggacatgccaacgccaccaaccaccccgacggcggggccgaactccgcatcaccctccccacaccgcggccgcccttccacgaggagcttccgcggatcacgtcatcagatacaaaggacccgaatcgggagcacgacactagcgaccaatag

SEQ ID NO: 98 - DNA, 609 bp, Mycobacterium Tuberculosis
gtggcgtgctgtaggaacagaggtatgaatctcgcggcgtgggccgagcgcaatggcgtcgcgcgggtgaccgcgtatcgctggttccacgctgggctcttgccggtcccggcccggaaggttggtcgactcattctggtcgacgagctggctagcgaggctggcgcgcagccaaagactgcggtgtacgcgcgggtgtcgtcggctgatcagaagtctgatttggatcggcaggtggcgcgggtgacttcgtgggccacagccgaacagatcccggtcgacaaggttgtcaccgaggtcgggtcggtgctcaacgggcaccgacgtaagttccctgcggtgctgcgcgatctgtcggtcacgcggattgtggttgagcatcgggatcggttctgccggttcggttcggagtatgtccacgctgcgctggccgctcagggtcgggagttggtcgtggtggactcggccgaggttgacgatgacctggtatgggatatgaccgagattctgacctcgatgtgcgcaaggttgtatggcaaacgtgctgctcagaaccgggccaagcgggccgtcgcggctgccgctgtcgatgatcatgaggcggcctga

SEQ ID NO: 99 - DNA, 606 bp, Mycobacterium Tuberculosis
gtgttggggccgatccggcaaccgcgcctgacggtgcggccagggcggctgccggggatgatcgccggcgtggcggcgaaacgaatgaaccgcgaacagttcttccgcgcggcgtcggggctcgatgaggatcgcctacggaaggcgctgtggaacctctactggcgcggcaccgcaaacatgcgggagcgcatcgaggccgagctggccagcgccgggcgcgctcgcccggcgcgcaaaataaagccgccggccgatccggacatcgtgggttgggaggtcgacgagttcgtgtcactggcgcggtcgggtgcctacctgggcggggaccggcgggtgtcgccgcgggaacgatcgcgctggcgtttcaccttcaagcggctcgccgcggaagcccaggacgccctgcgagccgaggacgccgagcccgcggcatccgcactggagcaactgatcgacctggcgcgcgaggccgacgggtacgactacttccgctccgacgatccggtggcagcggcgggtttcgtcgtgtccgatgtggcggcggcgggccacccacacttccgtgagttcgccgccgagatcggtgcggcgatcccgccgtga

SEQ ID NO: 100 - DNA, 2568 bp, Mycobacterium Tuberculosis
gtggccgaagcgttcgatgcgacccaagccgtggcgagaatcctggccgaacatggcccattgagcgaggacgacatcgcacgacgcctgctggacagcggcgtggccgacccggacgccgtcctgcgcgcgcttcgccttgaaacggaatggccggcaaggcagttggtcgacgatcggtgggtgtggctgccgacgctgctagccgggcgggtattcacccatcggctcggcgcggacgaggcggtccacgacatgctcggcgtgaccccggacctggacccgatcaccacgctctgcgagcacgaggagtatggccggctggccgacggttcggcggcgcggatcgtgctggccggatacgacgaggagctgctcgaacgacggggcatcccggacgaggccatcgaccccggcggggcactgctgctggagccgggcacgctggcgacgttgggggccgccgcgggggatctggtcggtgtgcggctgaccgccgcagggctggtgctcgagcggatcggcacagccggtgcggacacctccgtcggcgcccggctggccgagctggtcgaccccgacgagcccgcgttcttccccgcggcggtctggacggcgtgcgtcgacgacccggcggcatttaccgagccagtggcaccgctgcgcgagatcctcgaccagcacggcctcacgcacgaagacgactggctagcacctggcggattcaatttcgacgcttggcgtttcgagaaccgatgcgaactgctggcctttcgccacgacctcgaccccaacgacgcggtcgcgctgtacacgctgatcaaactgcacgagacgatgtcgctgctgctcgaagcaaccgacccggacgagttgccgcgggatgtgctcgccacagccgccgagaccgcgacggaaaccggctccgactcgttggtcgatctgctcggcgacattggggcggcgctggccgacccgctgctggccgagctgctggtggcagagacggtgggcaccgactccggcggggcggccgcgctgggcctgctcaccgagatgctggagcccaaggtgccgcgcgcggcgcgggtggcggtgcgctggctgcgcgcggtcgcgctggaccggatcggtgatgtcgaggcggccgaacgtgagctgctggcggccgagtcgatggacaccgagtggccgctgccgttgctcgacctggcccgcatcgcctccgatcgcggcgacgccgagcgcgggttggcactgctgcgccgcgccggcaccgaacccgaccacccgctggtgcggctcctggagcggcaccgagcccagccgcgccgcgacctgggccgcaacgaggcgtgctggtgcgggtcgggccgcaagtacaagaaatgccatctcggccgtgaggcgctgccgctggccgagcgggtggactggctgtatgccaaggcatcccagcacgcactgtcgggcgactggaccggcctgctggccgaagtcagctatgagcgcttccggtatgccgactctgacgatgaggacgcgctggccgcggcgctggccgatccgctggtgctggacgcggtgttgttcgagggcggcgcgttcgcggagttcctcgaagtgcgcggttcgctgctacccgacgacgagcggctgcttgccgagcaatggctgctcgtggagcggtcggtgttcgaggtcgagcacgtgcaacctggcgagggcgtgatcgtgcgcgacgtacgcaccggcgacacccatgaggtgcatgagcgggcggccagccgccagctgcgagccgggcagctgatctgcgcgcgcccggtgcccgccggggacaccatggtgttcttcggcgggatcgagccggtcgcgctgcacgagcgtgccgtgctgatcgagctgctcgatgacgagcccgacccggtgacactggtggcccagctgagccgccggttcgcgccgccgacactggtcaacaccgagggcgactcgctggcaatctgcgaggccagcgtgcgagtcgacgatccggccgggatccagggcgcgctcgacggggtctacgaccgggttgacggcgaggagccgccgcggtggatcgaacacgtcaccaacgacggcatgctgcgggtccgggccacgctggtcctcgacggtgacacgctgcgggtggaaaccaacagcgaaccgcggatggatcgcgtgctggccacgctgacccgcctcgacccggcgatgacggtgctcgacgacgaccgccgtccgctgcgcaacacccgcgaggccgccgcgctggccgagcagatgccagttaccggcgcgggcgcgcccgaccccgacagccccgagctggccgccgcgctcgaggaattcatccgcgactacgagaccagctggctcgatcaacccatccccgcgctggacgggcacacgccgcggcaggccgccgacgaccccacccgccgcgccgacctgatcaagctcctggacacgtttcccgccggcgcgggcgcccgtggcgggatggacgccgaccggctgcgcaccgctttgggcttgtag

SEQ ID NO: 101 - DNA, 408 bp, Mycobacterium Tuberculosis
gtgagcacgacgccggccgccggagtgctcgacacgtcggtgttcatcgcgaccgaaagcggccggcaactcgacgaggcgctgatccccgaccgggtcgccaccaccgtcgtcaccctcgccgaactgcgcgtcggcgtgctggccgcggcgacgaccgacatccgggctcaacgcctggcgaccctggaatccgttgccgatatggaaacgttgcccgtcgacgacgatgccgcccgaatgtgggcccgattgcggatccatcttgccgagtccggtcgccgggtgcggatcaacgacctgtggatcgcggccgtcgcggcatcgcgagcgctgccggtcatcacccaggacgacgacttcgccgccctcgacggtgcggccagtgtggagatcattcgggtctga

SEQ ID NO: 102 - DNA, 1152 bp, Mycobacterium Tuberculosis
gtgcggatcggagtcggggtttccaccgcgccggacgtgcgccgggccgcggcggaggctgccgcgcacgcgcgcgaggagctcgcgggtgggacgccggcgctggccgtgctcctcggatcgcggtcacacaccgaccaggccgtggacctgctggctgcggtgcaggcgtcggtcgagccggccgcgctgatcggttgcgtggcccaaggcatcgtcgccggtcgccacgagctggagaacgagcccgcggtggcggtgtggctggcgtccggcccacccgcggagacattccacctggacttcgttcgcaccggctcgggcgctctgatcaccggttaccgcttcgaccggaccgcgcacgacttgcacctgctgctgccggacccgtactcgttcccgtcgaatctgctcatcgagcacctcaacaccgacctgccgggaacgaccgtcgtcggcggggtggtgagcggtgggcgtcggcggggcgacacccggctgtttcgtgaccgcgacgtgctcacctccgggctggtcggcgtgcgcctgcccggcgcgcacagcgtttccgtggtgtcgcagggctgccggccgatcggggaaccgtacattgtcaccggcgcggacggtgccgtgatcaccgagctgggcggccgaccgccgctgcaccgcctgcgggagatcgtcttggggatggcgcccgacgagcaggaactggtcagccgcggcctgcagatcggaatcgtcgtcgacgagcacctggcggtgccgggtcagggcgactttttgatccgcgggctgctcggcgccgacccaacgacgggggcgatcgggatcggcgaggttgtcgaggtcggcgcgaccgtgcaattccaggtccgggacgcggcggcggccgacaaggacctgcgcctggccgtcgagcgggcggcggcggagctgcccgggcccccggtcggtgggctgctgttcacctgcaacgggcgcggacgacgaatgttcggggtcaccgaccacgacgcgtcgacgatcgaggacctgctgggcgggattccgctggccggtttcttcgccgccggggagatcggcccggtcgcgggccacaacgcgttgcacgggtttaccgcgtcgatggcgctgttcgtcgactga

SEQ ID NO: 103 - DNA, 696 bp, Mycobacterium Tuberculosis
atgagcgacccggtcagctatacccgcaaggattccatcgccgtcatcagtatggacgacggcaaggtcaacgcactgggcccggcgatgcaacaagccctcaatgcagcgatcgacaacgcggaccgtgatgatgttggggcgctggtgatcaccggtaatggccgggtattcagcggaggcttcgacctgaagatcctcacctccggtgaagtgcagcccgcgatcgacatgctcaggggcggcttcgagctggcgtatcgcctcttgtcctaccccaaaccggtggtgatggcgtgcaccggtcacgccatcgccatgggcgcgtttctgttgtcctgcggcgatcatcgggtggcggcccacgcatacaacatccaggccaatgaggtcgcgatcggcatgaccattccgtacgcggcgttagagatcatgaagctgcgactgacccggtcggcataccagcaggcaaccgggctggccaagacgttcttcggggaaaccgcgctggccgccgggtttatcgacgagatcgccctgccggaggtggtggtcagccgcgccgaggaagccgcacgagagttcgccggtctcaaccaacacgcccatgccgcgaccaagttgcgctcccgcgccgacgcgctcactgcgattcgggccgggatcgacgggatagcagccgagttcgggctgtaa

SEQ ID NO: 104 - DNA, 501 bp, Mycobacterium Tuberculosis
atggcgctcaagaccgatatccgcgggatgatttggcggtacccggactacttcatcgtgggccgtgagcaatgccgcgagtttgcccgagctgtcaagtgcgaccacccggcctttttcagcgaggaagcggccgccgacctcggttacgacgcgctggttgctccgctgaccttcgtgacgatcctcgccaaatatgtgcaactggacttcttccgccacgtcgacgtgggcatggagacgatgcagatcgttcaggtcgaccagcggttcgtgttccacaaacccgtgctcgccggggacaagttgtgggctcggatggacatccattcggtggacgagcggttcggcgcagacatcgtcgttaccagaaacctctgcaccaacgacgacggtgagctggtcatggaggcctacaccacgctgatgggccagcagggtgatggttccgccagactcaaatgggacaaggaatccgggcaggtcatcaggaccgcgtaa

SEQ ID NO: 105 - DNA, 864 bp, Mycobacterium Tuberculosis
atggtcaacgacctaacgccgcacttcgaggacgtgcaggcacactacgacctgtccgacgacttcttccggctgttcctggatccgacccagacctacagctgcgcgcatttcgaacgcgaggacatgacgctggaagaggcccagatcgccaagatcgacctggcgctgggcaagctaggtctgcagcccggcatgacgctgctcgatatcggttgcggctggggcgccaccatgcggcgcgcgatcgcgcagtatgacgtcaacgtcgtcggcctgacattgtcgaagaaccaggccgcccatgtgcagaagtcgttcgacgagatggacaccccgcgcgacaggcgagtgttgctggcgggatgggagcagttcaacgagcccgtcgaccgcatcgtgtcgatcggcgcgttcgagcacttcggccacgatcgtcacgccgacttcttcgcccgggcccacaaaatcctgccgcccgatggcgtgttgctgctgcacacgatcaccggcctgaccaggcagcagatggtcgaccacggcttgccgctcacgttgtggctggcccgctttctcaagttcatcgcgaccgaaatcttcccggggggccaacctccgacgattgaaatggttgaggaacagtcggcgaagacgggtttcacgctgactcgccgccagtcgctgcagccgcattacgccaggaccctcgacctgtgggccgaggcgctgcaggaacacaaaagcgaggccatcgcgatccagtccgaagaggtctacgagcggtacatgaaatacctgaccggctgcgccaagctgttccgggtcggctacatcgacgtcaaccagttcacgctggcgaagtag

SEQ ID NO: 106 - DNA, 3951 bp, Mycobacterium Tuberculosis
gtgctcgacgtcaacttcttcgatgaactccgcatcggtcttgctaccgcggaggacatcaggcaatggtcctatggcgaggtcaaaaagccggagacgatcaactaccgcacgcttaagccggagaaggacggcctgttctgcgagaagatcttcgggccgactcgcgactgggaatgctactgcggcaagtacaagcgggtgcgcttcaagggcatcatctgcgagcgctgcggcgtcgaggtgacccgcgccaaggtgcgtcgtgagcggatgggccacatcgagcttgccgcgcccgtcacccacatctggtacttcaagggtgtgccctcgcggctggggtatctgctggacctggccccgaaggacctggagaagatcatctacttcgctgcctacgtgatcacctcggtcgacgaggagatgcgccacaatgagctctccacgctcgaggccgaaatggcggtggagcgcaaggccgtcgaagaccagcgcgacggcgaactagaggcccgggcgcaaaagctggaggccgacctggccgagctggaggccgagggcgccaaggccgatgcgcggcgcaaggttcgcgacggcggcgagcgcgagatgcgccagatccgtgaccgcgcgcagcgtgagctggaccggttggaggacatctggagcactttcaccaagctggcgcccaagcagctgatcgtcgacgaaaacctctaccgcgaactcgtcgaccgctacggcgagtacttcaccggtgccatgggcgcggagtcgatccagaagctgatcgagaacttcgacatcgacgccgaagccgagtcgctgcgggatgtcatccgaaacggcaaggggcagaagaagcttcgcgccctcaagcggctgaaggtggttgcggcgttccaacagtcgggcaactcgccgatgggcatggtgctcgacgccgtcccggtgatcccgccggagctgcgcccgatggtgcagctcgacggcggccggttcgccacgtccgacttgaacgacctgtaccgcagggtgatcaaccgcaacaaccggctgaaaaggctgatcgatctgggtgcgccggaaatcatcgtcaacaacgagaagcggatgctgcaggaatccgtggacgcgctgttcgacaatggccgccgcggccggcccgtcaccgggccgggcaaccgtccgctcaagtcgctttccgatctgctcaagggcaagcagggccggttccggcagaacctgctcggcaagcgtgtcgactactcgggccggtcggtcatcgtggtcggcccgcagctcaagctgcaccagtgcggtctgcccaagctgatggcgctggagctgttcaagccgttcgtgatgaagcggctggtggacctcaaccatgcgcagaacatcaagagcgccaagcgcatggtggagcgccagcgcccccaagtgtgggatgtgctcgaagaggtcatcgccgagcacccggtgttgctgaaccgcgcacccaccctgcaccggttgggtatccaggccttcgagccaatgctggtggaaggcaaggccattcagctgcacccgttggtgtgtgaggcgttcaatgccgacttcgacggtgaccagatggccgtgcacctgcctttgagcgccgaagcgcaggccgaggctcgcattttgatgttgtcctccaacaacatcctgtcgccggcatctgggcgtccgttggccatgccgcggctggacatggtgaccgggctgtactacctgaccaccgaggtccccggggacaccggcgaataccagccggccagcggggatcacccggagactggtgtctactcttcgccggccgaagcgatcatggcggccgaccgcggtgtcttgagcgtgcgggccaagatcaaggtgcggctgacccagctgcggccgccggtcgagatcgaggccgagctattcggccacagcggctggcagccgggcgatgcgtggatggccgagaccacgctgggccgggtgatgttcaacgagctgctgccgctgggttatccgttcgtcaacaagcagatgcacaagaaggtgcaggccgccatcatcaacgacctggccgagcgttacccgatgatcgtggtcgcccagaccgtcgacaagctcaaggacgccggcttctactgggccacccgcagcggcgtgacggtgtcgatggccgacgtgctggtgccgccgcgcaagaaggagatcctcgaccactacgaggagcgcgcggacaaggtcgaaaagcagttccagcgtggcgctttgaaccacgacgagcgcaacgaggcgctggtggagatttggaaggaagccaccgacgaggtcggtcaggcgttgcgggagcactaccccgacgacaacccgatcatcaccatcgtcgactccggcgccaccggcaacttcacccagactcgaacgctggccggtatgaagggcctggtgaccaacccgaagggtgagttcatcccgcgtccggtcaagtcctccttccgtgagggcctgaccgtgctggagtacttcatcaacacccacggcgctcgaaagggcttggcggacaccgcgttgcgcaccgccgactccggctacctgacccgacgtctggtggacgtgtcccaggacgtgatcgtgcgcgagcacgactgccagaccgagcgcggcatcgtcgtcgagctggccgagcgtgcacccgacggcacgctgatccgcgacccgtacatcgaaacctcggcctacgcgcggaccctgggcaccgacgcggtcgacgaggccggcaacgtcatcgtcgagcgtggtcaagacctgggcgatccggagattgacgctctgttggctgctggtattacccaggtcaaggtgcgttcggtgctgacgtgtgccaccagcaccggcgtgtgcgcgacctgctacgggcgttccatggccaccggcaagctggtcgacatcggtgaagccgtcggcatcgtggccgcccagtccatcggcgaacccggcacccagctgaccatgcgcaccttccaccagggtggcgtcggtgaggacatcaccggtggtctgccccgggtgcaggagctgttcgaggcccgggtaccgcgtggcaaggcgccgatcgccgacgtcaccggccgggttcggctcgaggacggcgagcggttctacaagatcaccatcgttcctgacgacggcggtgaggaagtggtctacgacaagatctccaagcggcagcggctgcgggtgttcaagcacgaagacggttccgaacgggtgctctccgatggcgaccacgtcgaggtgggccagcagctgatggaaggctcggccgacccgcatgaggtgctgcgggtgcagggcccccgcgaggtgcagatacacctggttcgcgaggtccaggaggtctaccgcgcccaaggtgtgtcgatccacgacaagcacatcgaggtgatcgttcgccagatgctgcgccgggtgaccatcatcgactcgggctcgacggagtttttgcctggctcgctgatcgaccgcgcggagttcgaggcagagaaccgccgagtggtggccgagggcggtgagcccgcggccggccgtccggtgctgatgggcatcacgaaggcgtcgctggccaccgactcgtggctgtcggcggcgtcgttccaggagaccactcgcgtgctgaccgatgcggcgatcaactgccgcagcgataagctcaacggtctgaaggaaaacgtgatcatcggcaagctgatcccggccggtaccggtatcaaccgctaccgcaacatcgcggtgcagcccaccgaggaggcccgcgctgcggcgtacaccatcccgtcgtatgaggatcagtactacagcccggacttcggtgcggccaccggtgctgccgtcccgctggacgactacggctacagcgactaccgctag

SEQ ID NO: 107 - DNA, 612 bp, Mycobacterium Tuberculosis
ttgggtcgcaggggtaaccgaagggtgcacgttgaccgcgtgaggctaaccggcaccgagcgtgaactgagggcggagaatcagagccccccgattttccgcccgcagaacacgttgggcgacggcgccaacgggctgccactggccgtgtgcaccacgacggctcacacgtgccacacttcccatactcacccatcgcggtggaccccaaacccagtgccggccaccaagggcgtccccgctggattggtgcaagcaaccttcatcatcgaaaaccttgaccccggcaacaacgacacgccgaccccccctacacccaaactgcgattagcccgaaaacctgggcaccataggcgatctgaatacgatgcggattcggtgctgcggagaaaggatacatcgcgccgatgcgtccaggcggatgacgtccgatgcgtgcagctggtccaggatccgcggcgcggacgtgtcgaactcggtggttaccgcgccgagcttactgttggccgacgggcggcggtgaattgccaacgcccgcaatatggtgcggatggatggcccgttcggttgggttgcggggtaggcggcgccgcgcgaggcgatcagcgctga

SEQ ID NO: 108 - DNA, 234 bp, Mycobacterium Tuberculosis
atggcagtgggtgtctcgccgggcgaactgcgtgagctcaccgacgaggagctggccgagcggttgcgcgagtccaaggaagagttgttcaacttgcgtttccagatggcgaccggccagctcaacaataaccgccggctccgtacggtgcgtcaggaaatcgcgcgcatctacaccgtgctgcgcgaacgagaactgggtctggcgactgggcccgatggtaaggaatcgtga

SEQ ID NO: 109 - DNA, 411 bp, Mycobacterium Tuberculosis
gtgatggcagaggctaagaccggcgcgaaggcggcgcctagggtggctaaggccgccaaggcggcccccaagaaggccgcacccaacgacgctgaggccataggtgcggccaacgcggcaaacgttaaggggcccaagcacactccgcgtactccgaagccacgcggccgccgcaagacacgaatcggctatgtggtgagcgacaaaatgcagaagaccattgtggtggagctggaagaccgcatgcggcacccgctatacggcaagatcatccggaccactaagaaggtcaaggcacacgacgaagacagcgttgccggcattggcgaccgtgtctcgctgatggagacgcgtccgctgtcggcgaccaagcgctggcggctcgtcgagatcctcgagaaggctaagtaa

SEQ ID NO: 110 - DNA, 369 bp, Mycobacterium Tuberculosis
gtgattcagcaggaatcgcggctgaaggtcgccgacaacaccggcgccaaggagatcttgtgcatccgggtgctgggcggttcgtcgcgacgctacgccggcatcggtgacgtcatcgtcgccaccgtgaaggacgccattccgggcggcaacgttaagcggggggatgtcgtcaaggccgtcgtggtgcgcacagtcaaggaacgccgacgtcccgacggcagctacatcaagttcgacgagaacgccgcggtgatcatcaagcccgacaacgacccgcgcggcacccgcatttttggaccggtcggtcgcgagctgcgggagaagcggtttatgaagatcatttcgctggccccggaggtgttgtag

SEQ ID NO: 111 - DNA, 540 bp, Mycobacterium Tuberculosis
atgtcgcgtattggtaagcagccgattccggtgcccgccggggtcgacgtcacgatcgagggacagagcatctcggttaaggggcccaagggcaccctaggactgacggtcgccgagccaatcaaagtggcacgcaatgacgacggcgctatcgtggtcacccgtcccgacgatgagcggcgtaatcgctccttacacgggctgtcccgtaccctggtgtccaacctggtcactggcgtgacgcaggggtacaccaccaagatggagatcttcggggttggctatcgggtgcagctcaagggctccaatctggagtttgcgctggggtacagccacccggtggtgatcgaggctcccgaaggaatcacgttcgccgtccaggcaccgacgaagttcaccgtttccgggatcgacaaacaaaaagtcggccagatcgccgccaatatccgccgtcttcgccgtcccgatccgtacaagggcaagggcgtgcgctacgagggcgagcagatccgccgcaaggtcggaaagacaggtaagtag

SEQ ID NO: 112 - DNA, 369 bp, Mycobacterium Tuberculosis
atggcgcaatcagtttccgcgactcgacgaatctcccgcctgcgccggcacacgcggctgcggaagaagctctcgggcaccgcggagcgcccgcggctggtggtgcatcggtccgcgcggcacatccacgtgcaactggtgaacgacctcaacggcaccaccgtggccgccgcttcgtcgatcgaggccgatgtgcgcggcgtgccgggtgacaaaaaggcccgcagtgtgcgggtcggccagttgatcgccgagcgggccaaagccgccggcatcgacaccgtggtattcgaccgcggcgggtatacctacggcggacgaatcgccgcgctggccgacgccgcacgcgagaacggattgagtttctga

SEQ ID NO: 113 - DNA, 1326 bp, Mycobacterium Tuberculosis
gtgctttcggctttcatctcgtcgctgcgaacagtcgacttgagacgaaagatcctcttcacgctgggcatcgtcattctctaccgtgtcggtgccgcgctgccgtcccccggtgtcaattttccgaacgtgcagcagtgcatcaaagaagccagcgcgggcgaagccggacagatctattccctgatcaacctgttctccggcggtgcgttattaaagctcacggtgttcgcggtgggggtgatgccctacatcaccgccagcatcatcgtgcagctgctcaccgtggtcatcccgaggttcgaggaactccggaaggaaggccaggcgggtcagtcgaagatgacccagtacacccgttacctagcgatcgcgttggctatccttcaagccaccagcatcgtggcgttggctgccaacggcgggttgctacaaggttgctcgctggacatcatcgccgaccagagcattttcacactggtcgtcatcgtgctcgtgatgacgggcggcgccgcgttggtgatgtggatgggcgagttgatcaccgaacgcggcatcggcaacggcatgtcgctgctgatcttcgttggcatcgctgcccgcatcccggccgaaggtcaaagcatcctggaaagccgcggtggagtcgtcttcaccgcggtctgcgcggccgcgttgatcatcatcgtcggtgtggtgttcgtcgaacagggtcagcgccggattccagtgcaatacgccaagcgcatggtgggccggcggatgtatggcgggacttcgacttatctgccgctcaaggtcaaccaggccggcgttatcccggttatcttcgcgtcgtcgctgatctacattccgcacctgatcacccagctgattcgcagcggcagcggtgtcgtgggaaacagctggtgggacaaattcgtcggcacgtacctgtccgacccgagcaacctggtctacatcggcatctacttcggcctcatcatcttcttcacctacttctacgtgtcgatcaccttcaaccccgacgaacgtgccgacgagatgaagaagttcggcggcttcattccgggaattcggccgggccgtccgaccgcagactatctgcgctatgtgctgagccggattaccttgccgggctcgatttacctcggcgtgatcgccgtgctgcccaacctgttcctccagatcggcgccggtggaaccgtgcagaacctgccctttgggggtaccgcggtgctgatcatgatcggtgtcggtttggatacggtcaagcagatcgagagtcagctcatgcagcgcaactacgaagggttcctcaagtga

SEQ ID NO: 114 - DNA, 498 bp, Mycobacterium Tuberculosis
gtggcctcagataatcgcgaccccatcgccgcagcacgggccaactgggagcgttccgggtggggtgatgtgtcgctaggcatggtggcggtgacgtcggtgatgcgtgcgcatcagattctgctggcccgcgtcgagacggcgctgcgcccctatgacctgagtttctcccgcttcgagctgctgcggctgctggcgttcagccgtatcggagcgctaccgatcaccaaagcgtcggaccgattgcaggttcacgtgaccagcgtcacccacgcgatccgccggctggaggccgatggattggtgcggcgggttccgcaccccaccgacgggcggaccacactggtgcagatcaccgagctgggtcgctccacggtcgaggacgccaccgtcaccctcaacgagcaggtgttcgccaacgttgggatgggcgccgaggaatcgcaggcgctggtgtcggccgtcgaaacgttgcggcgcaacgccggcgacttttga

SEQ ID NO: 115 - DNA, 207 bp, Mycobacterium Tuberculosis
atgggctatcgagtcgaagccgaccgggatctgtgccaaggacacgcgatgtgcgagctggaggcacccgagtatttccgggtgcccaagcgcggccaggtcgaaatcctcgaccccgagccgcccgaggaagcccgcggcgtgatcaagcatgccgtgtgggcctgtcccacccaggcactgtccatccgagaaacgggagagtaa

SEQ ID NO: 116 - DNA, 1269 bp, Mycobacterium Tuberculosis
gtgcgcgtcctggtaatcggttcgggtgcccgcgaacatgcgctattgctggcgctcggcaaagacccgcaggtttcggggctaatcgttgctcccggcaatgcaggcaccgctcggatcgccgagcagcacgacgtcgacatcacctccgccgaggcggtggtcgccctggctcgcgaagtcggcgctgacatggtggtgattggccccgaggtaccgttagtgctcggggtggccgacgccgtgcgcgcggccggcatcgtgtgtttcgggcccggtaaggacgcggctcgcatcgaaggctccaaagcattcgccaaggacgtcatggcggcggccggtgtgcgcaccgcgaacagcgaaatcgtagacagcccagcgcacttggacgcggccctggaccggttcgggccgcctgccggtgacccggcctgggtggtcaaagacgaccggctagccgccggcaagggtgtggtggtgacagcggaccgcgatgtcgcgcgcgcacacggagctgccctgctcgaggccgggcacccggtgttgctggagtcctacctggacggcccggaggtatcgctgttctgtgtcgtcgaccgcaccgtcgtggtgccgctgctgccggcacaggacttcaagcgagtcggtgaggacgacaccggacttaacaccggcggtatgggcgcctacgcgccgctgccgtggttgcccgacaacatctatcgggaggtggtcagccggatcgtcgaacccgttgcggccgaactagtccggcgtggaagctcgttttgcggattgctgtatgttggtctcgcgattaccgcccgcgggccggcggtggtcgagttcaactgccgattcggcgatccggagacccaagccgtgctggccttgctggagtctccgctcggccaactgcttcatgccgccgctaccgggaagctggccgatttcggcgagttgcggtggcgtgacggtgtggccgtaacagtggtactggcggccgaaaactatcccgggcgcccccgggtcggcgacgtcgttgtcggctccgaagccgagggggtgctgcacgccggaaccacgcggcgcgacgatggcgcgatcgtttcgtccggtggccgggtgctgtcggtggtgggcaccggtgccgacttgtccgcagcacgcgcacacgcgtatgaaatcctcagttcaattcggttgccaggaggtcatttccgcagcgatatcggtttacgggcggccgaggggaagatcagcgtctag

SEQ ID NO: 117 - DNA, 621 bp, Mycobacterium Tuberculosis
atgagatcgcgcttcttgccgtatgccaccacgcccggccgactgctggcccaactgatcagcgatatcactgtcgcggtgtggacgacgctatggatgctcgtcggcctcgccgtgcacgacgccatctcgataatcggcgaggccggccgccaaatcgaaatcggctcgcacgggattgccggcaacctggcggccgcgggccaggacgcccagcgtatcccggtggtgggcgacgcgctcagcaaccccatcaccgccgcaagccaggccgcccttgacatcgccggcgccggccacaacctggacaccacggccggctggcttgcggtagtgctcgcgctggcggtcgccgcgacgccgattcttgccgtggccatgccctggctgttcctgcggctgcggttctgccggcgcaagtggaccgttaccaccctggcggcgaccccagccggtcgccagctgctggcgctgcgcgcattggcgaaccggccgccgggcaaactggccgccgtcagcaccgatccggtcggcgcctggcgacgagaggatcccgccaccatgcgtgcgctggccgcgctcgagttgcgggccgccggaatcccgctgcgcggggactag

SEQ ID NO: 118 - DNA, 1623 bp, Mycobacterium Tuberculosis
atgctcggcaacgccatggttgaagcgtgtcccgcggaaggcgatgccccggtgcccatcacccccgcggggcggccccgctctggccaacgcagctatcccgataggctcgatgtggggttgcttcggaccgccggagtgtgtgtcctggcctcggtgatggcacatgtggacgtcaccgtggtcagcgtcgcgcaacgcaccttcgttgccgatttcgggtccacccaggccgtcgtggcctggaccatgaccggctacatgctcgcgttggccactgtgatcccgacagccggttgggcggccgaccggttcggcaccaggcggcttttcatgggttcggtattggcgttcaccctcggctcactgctgtgcgcagtagcaccaaacatcttgctgctcatcatatttcgtgttgtccagggtttcggtgggggcatgctgacgccggtgtcctttgccatcttggcccgtgaggcgggcccgaagcggctggggcgcgtgatggcggtggtgggcattccgatgctgctcggcccggtcggtgggccgatcctgggtggttggctcatcggggcctacggctggcgttggattttcttggtcaacctgccggtcgggctgtccgcgctcgtcttggcggcgatcgtgttcccaagagatcgcccggcagcgtcggaaaacttcgactacatgggcctcttgttgctgtcgccgggcctggcgaccttcctgttcggggtgtcatctagccccgcccgtggaacgatggccgatcggcacgtgttgataccggcgatcaccggcctggcgttgatcgcggcattcgtcgcacattcgtggtaccgcacagaacatccgctcatagacatgcgcttgttccagaaccgagcggtcgcgcaggccaacatgacgatgacggtgctctccctcgggctgtttggctccttcttgctgctcccgagctacctccagcaagtgttgcaccaatcaccgatgcaatcgggggtgcatatcatcccacagggcctcggtgccatgctggcgatgccgatcgccggagcgatgatggaccgacggggaccggccaagatcgtgctggttgggatcatgctgatcgctgcggggttgggcaccttcgcctttggtgtcgcgcggcaagcggactacttacccattctgccgaccgggctggcaatcatgggcatgggcatgggctgctccatgatgccactgtccggggcggcagtgcagaccctggccccacatcagatcgctcgcggttcgacgctgatcagcgtcaaccagcaggtgggcggttcgatagggaccgcactgatgtcggtgctgctcacctaccagttcaatcacagcgaaatcatcgctactgcaaagaaagtcgcactgaccccagagagtggcgccgggcggggggcggcggttgacccttcctcgctaccgcgccaaaccaacttcgcggcccaactgctgcatgacctttcgcacgcctacgcggtggtattcgtgatagcgaccgcgctagtggtctcgacgctgatccccgcggcattcctgccgaaacagcaggctagtcatcgaagagcaccgttgctatccgcatga

SEQ ID NO: 119 - DNA, 729 bp, Mycobacterium Tuberculosis
atgacgctagccaacaatggaaccggcatggaccactttctgacgcccacggagtacctcgacgcgggccatccgctcgttcgtacgacggcagcaaccctcatccgggacgcggtgtcggataccgagcgggtcaggcggatctactactacgtgcgcgacgtgccatacgacgtcctcgcgtcctttcgctacctcgcgcagggacatcaccgcgccagcgacgtgatcggccacggggtcgccttctgcatgggcaaggcaagttccttcgtcgccctgtgccgagccgccggtgtcccggcccgtatcgcgttccagacgatcgacgcccccgataaggagtttctgtccccgcaggtacgtgccctatggggaggccgaactggccggcccttcccgtggcactcgctgggtgaggcatatcttggtcggcgatgggtcaagctggacgccaccatcgacgcacccaccgccgcccgcctcggcaagccctaccggcaagaattcgacggagctaccccgatcccgacggtggaaggaaccatcctgcgggaaaacggcagctacgccgactatcccagcgcggtcgcgcaatggtacgaacgaatcgctcagtcggtcctgaaggcgttgcagtccaccgaagtacacgccttggtagccgctgacgaggaactgtggaccggccccccggttgaattggccgacgcaacccaccgactgtga

SEQ ID NO: 120 - DNA, 810 bp, Mycobacterium Tuberculosis
atgacatctgtcaagctggacctggacgctgccgatctgcggatatcgcgtggcagcgtgccggcgagtacccagcttgccgaggcgctaaaggcccagatcatccagcagcggctgccgcgcggcgggcgcttgcccagcgaacgagaattgatcgaccgttccggtttgagccgcgtgaccgtgcgcgcggcggtcggcatgctgcaacgtcagggatggctagtgcgccggcaaggcttgggtaccttcgtcgccgatccggtggaacaggagctcagttgcggcgtgcgcaccatcacagaggtgttgttgagctgtggtgttaccccgcaggtcgacgtgctgtcacaccagaccggaccggcgccgcaacggatttccgagacgctgggtttggttgaggtcctctgtattcgccggcgcatccgcactggcgatcaacccttggccctggtcacggcctatcttccgcccggcgtgggcccagccgtcgagccgttgctatcgggcagcgcggacaccgaaaccacatatgcgatgtgggagcggcgactgggtgtacgcattgcacaggctacccacgaaatccatgccgccggggcctcccccgacgtagccgacgcgttgggtctggcggtgggttcgccggtactggtcgtcgaccgcaccagctacaccaatgacggcaagccccttgaagtggtcgtgttccaccatcgccccgagcggtaccagttctccgtcacgttaccccgaacgttgcccggatcaggtgccggaattatcgagaaacgagatttcgcatga

SEQ ID NO: 121 - DNA, 798 bp, Mycobacterium Tuberculosis
atgaacaatctctaccgcgatttggcaccggtcaccgaagccgcttgggcggaaatcgaattggaggcggcgcggacgttcaagcgacacatcgccgggcgccgggtggtcgatgtcagtgatcccggggggcccgtcaccgcggcggtcagcaccggccggctgatcgatgttaaggcaccaaccaacggcgtgatcgcccacctgcgggccagcaaaccccttgtccggctacgggttccgtttaccctgtcgcgcaacgagatcgacgacgtggaacgtggctctaaggactccgattgggaaccggtaaaggaggcggccaagaagctggccttcgtcgaggaccgcacaatattcgaaggctacagcgccgcatcaatcgaagggatccgcagcgcgagttcgaacccggcgctgacgttgcccgaggatccccgtgaaatccctgatgtcatctcccaggcattgtccgaactgcggttggccggtgtggacggaccgtattcggtgttgctctctgctgacgtctacaccaaggttagcgagacttccgatcacggctatcccatccgtgagcatctgaaccggctggtggacggggacatcatttgggccccggccatcgacggcgcgttcgtgctgaccactcgaggcggcgacttcgacctacagctgggcaccgacgttgcaatcgggtacgccagccacgacacggacaccgtgcgcctctacctgcaggagacgctgacgttcctttgctacaccgccgaggcgtcggtcgcgctcagccactaa

SEQ ID NO: 122 - DNA, 348 bp, Mycobacterium Tuberculosis
atggcactcaaggtagagatggtcactttcgactgcagcgaccctgcgaagcttgccggctggtgggccgagcagttcgatggcacgacgcgtgaactgctgcccggcgaattcgtcgtggtcgcccggaccgatggaccgcggttgggattccagaaggtgcccgatcccgcccctgggaaaaaccgcgtgcacctcgacttcacgaccaaggacctggatgccgaggtgttgcgcctggtcgccgccggagccagtgaggtcgggcggcatcaggtcggcgagagctttcgctgggtggtgctggctgaccccgaaggcaacgctttttgcgtggcgggtcaataa

SEQ ID NO: 123 - DNA, 1584 bp, Mycobacterium Tuberculosis
gtggccgtagactcggattacgtcaccgaccgcgccgcagggagccgccaaaccgtgaccggccagcaacccgagcaagacctgaactcgccccgggaagagtgcggtgtcttcggggtctgggccccgggtgaagacgtcgccaaactcacctactacggcctgtacgcgttgcagcatcgcggccaggaagccgccgggatcgccgtcgccgacggctcccaggtgctggtcttcaaagacctcggcctggtcagccaggtgttcgacgagcagacgttggcggccatgcagggccatgtcgccatcgggcactgtcgttactccaccaccggggacacgacgtgggagaacgcccagcccgtgttccgcaacaccgccgctggcaccggtgttgcgttgggccacaacggaaatctggtcaatgccgctgcccttgccgcccgcgcccgcgacgcggggttgatcgccacccgctgcccagccccggcgacgacggactccgacattctgggggcgctgctggcccacggtgctgccgattccaccctcgaacaggcggcgctggacctgctgcccacagtgcggggagcgttctgtctgacgttcatggacgaaaacacgctttatgcgtgccgcgacccgtacggggtgcgcccgctatcgctcgggcgtttggaccgtggctgggtggtggcctccgaaacggccgcactcgacatcgtcggcgcctcgttcgtccgtgatatcgaaccgggcgaattgctggctatcgacgccgacggggtgcggtccacccgctttgccaaccccacgcccaagggctgcgtattcgaatacgtctacctggcgcggccggacagtacgatcgccggccggtcggtacacgccgcgcgggtggagatcggtcgccgactggctcgggaatgcccggtcgaggccgacttggtgattggtgtgccggaatccggcacacccgccgcggtcggctacgcgcaggagtccggcgttccatatgggcagggtctgatgaagaacgcctatgtcgggcgcaccttcatccagccgtcacagaccatccgtcagctcggcatccggctgaagctcaacccgctcaaagaggtgatccgcggcaagcggctcatcgtcgtcgacgactcgatcgtgcggggcaacacccagcgtgcgctggtacgcatgctgcgcgaggccggtgcggtcgaattgcatgtgcgcatcgcctcgccaccggtgaagtggccgtgcttctacggtatcgacttcccctcgccggccgagttgatcgccaacgccgtggaaaacgaggacgagatgctggaggcggtacggcatgccatcggggccgacacgctgggatacatctcgctgcggggcatggtcgcggcgtccgagcagcccacgtcgcggctgtgcaccgcttgcttcgacggcaagtatccaatagagctgccccgcgagaccgcgctaggcaaaaatgtcatcgagcacatgctcgccaatgcggcccgcggagccgcgctgggcgaactcgccgccgacgacgaagtccccgttgggcgctga

SEQ ID NO: 124 - DNA, 1056 bp, Mycobacterium Tuberculosis
gtgacccaagatacgtctgctacctgtccgctgaccagcaccgtgcaggattcctcgccggttgcgggccagcttggcaggcctatagggttccgcggactggccggcggttgccccgtgtcaccgctgggttacgaatcgccgccgctgccgctggggccggattcgctgacgtggcgatacttcggtgactggcgcgggatgctgcagggaccgtgggcgggatccatgcagaatatgcatccgcagctgggcgcggcggtcgaagatcattcgacgttcttccgggaacgctggccacggctgctgcggtcgttgtacccgatcggcggagttgtcttcgacggcgatcgagccccagtcaccggtgtgcaggtgcgtgactaccacatcaccatcaagggtgtcgacggtgcgggccgtcgctaccacgcgttgaatcccgacgtcttctactgggcgcacgccaccttctttgtcggcacgttgcatgtggccgagcggttctgcggtggcctgaccgaggcgcagcggcgccagctatttgacgagcacgtccagtggtaccgcatgtacggcatgagcatgcggccggtgccggcgacctgggaggagtttcaggactactgggaccacatgtgccgcaacgtgctggagaacaacttcgcggcgcgtgccgtgctcgacctgaccgaactacccaaaccgccattcgcccaacgagttccggattggctgtgggccgcgccgcgcaagttgctggcccggttcttcgtctggctgaccgtcggactctacgatccgcccgtgcgcgagctgatgggctaccggtggttgcgccgcgacgaatggttgcaccgccgctttggcgacatcgtccggctcgtctttgccttggtgccattccggtttcgcaagcacccgcgggctcgcgccggctgggaccgtgccaccggccgcatccccgccgatgcgccgctagtacagacgcccgcgcgcaacctgccgccgcccgacgagcgtgacaacccgacgcactactgccctaaggtctga

SEQ ID NO: 125 - DNA, 816 bp, Mycobacterium Tuberculosis
atgctccccgagacaaatcaggatgaggtccagcccaacgcacccgttgccctggtgacggtggaaatccgtcacccgacaacggattcgctcaccgaatcagcgaaccgggagctcaaacacctgcttatcaatgatctaccgatcgaacgccaggcgcaggacgtcagctgggggatgacggcgcccggtggagcccccaccccggtcgcggatcgtttcgttcgttatgtcaatcgcgataacaccaccgccgcttcactgaagaaccaggcgatagtcgtggagaccaccgcctaccgcagctttgaggcctttaccgacgttgtgatgcgggtcgtggatgctcgcgcgcaggtctcgtcaatcgttgggttggagcgtatcggtcttcgctttgttctggagatccgcgtccccgcgggtgtcgacggccggatcacgtggagcaactggatcgacgagcagctgctcgggccgcagcgtttcactcccggcggcctggtcctgaccgagtggcagggtgccgcagtctaccgtgagctacaaccaggcaaatcgctcatcgtgcgctacggcccgggtatgggccaagcgcttgatcccaattaccatctgcgccgaataacacccgcccaaaccggaccattcttcctgctggacatcgatagcttttggactcccagtggcggctccattcccgagtacaacagggacgccttagtgtcgacattccaggacctgtacggtccggcccaggtcgtgtttcaggagatgatcaccagtcgcctgaaagatgagctgcttcgccagtaa

SEQ ID NO: 126 - DNA, 2649 bp, Mycobacterium Tuberculosis
atgtctttcgtgattgcagcgccggacttggtggcgatggccacggaggatcttgcaggcatcggcgcgtccctgaccgctgccaatgcggcggccgccgtcccgacaagcgggctgttggccgctgctggcgatgaggtgtcggcggccatcgcggcgttgttttccagccacggtcagcagtatcaggcgatgagcgcgcaggcggcggcgtttcatgcccggtttgtgcaggcactggccggggctatgggcgcctatgcggccgccgaagcggccaacgcgtcgccgttgcagaccctcgagcagggcttgctaggcgccatcaatgcacccgccgccgcgttgtcgggccgaccttttatcggcaacggcaccaacggcgccccggggaccggggaggccggtgggcctggaggctggttgttgggcaacggcggcaacggcggttcgggtgctccggggcagaccgggggtgccgggggtgccgccgggctgctgggccatggcgggaccggtggggccggaggcaccggcgcctcgggtggcaaaggcggcaccggcgggtggctgtggggtagcggcggagctggcggggccggcgggtccggcggcgggtccggtggggcgggtggcaacgcgctgatgttcggcattggcggcaacggcggagctggcggggccgccagcggagtcgggaacggcggggtcggcggcgccggtggagccggcggcgcgctggtagccatcggtggcgccggtggcgccggcggggccgctaccactggaaccggcggtgccggcggcgccggcagcaacgcattggggctgttccttggcctgggcgggtccggcggtcagggcggcgactcggccatgggaagcggcggtgccggcggtgccggtggctctggtggcgccgccagccccttcgggatcgacatcggcatcggcggtgccggcgggcacggcggcgcaggtactaacggcggtgccggcggcgccggcggtgccggcggttcctcgggcaccgttttcgcgctcgacttgagctggggcggtgctggcggcaatggtggcgcagctaccactgggaccggcggggccggcggcactggcggcttcgctgttgcccccgacttcatcgggttcggcgcggcctacggcggggccggcgggcttggtggggctgcgaccggtgccggcggcaccggcgggaccggtggcgttggtgccggcggcttcgcggctctgggcgtgggcgtcggcggcgccggcggggctggcggggccgccaccgagaccggcggcatcggcggcgccggcggattgggcgtcgggctgctgggcggcgccggcggcgccggcggtcccggcggcgccgcttcggctggtagcggcggccatggcgggaccggcggcgatgccctcggattgatcggcgccggcatcggcggcgtcgggggggttggcggagccgccaccgacaccggcggcaacggcggcgccggaggcagcgggaccgggctgctgggcggcgtgggcggcgccggtgggcacggcggcggggcttcggttggtaccggcggcagcggcggtgccggcggtgacggcttcggattcgtcggcgcaggtggcaacggcggcaacgccggcaccggagtcggggttaacggcgccaacggcggcaacggcggcagcgctaccggcgcactcgcggccgtcggcggggccggcgcggccggcggggacgccaccagcggaaccggcgggttcggcggtgctggcggcagcgcccgcggcctgatctttgccctgggcggcgctggagccgccggcggcgacgcttccacgggagtcggcggacccggcggtccgggtggcacgggcaccgccagcagccccttcgggatcgccatcgccatcggcggtgcgggcgcgcagggcggcgccggcactagcggcgccaccggcggagccggcggtgacggcgtcttcgagggcattgctgtcctcggcctaggctttggcggcgccgccggggctggtggtgccgccaccggggacggcgccaccggcggagccggcggcttcggcggcgccggcgctggcatcgcaaacttcctagggttctccgtgctgcacggcggcgccggcggagctggcggcaccgccaccgggaccggcggcaacgggggggccggtggcggtggcgggttgagctcacccgtgatcctgggcatcggcatcggcggcgccggcggcgacggtggtggcgccctgggggtgctgggcggcatgggcggcgacggcggcgacggcggcgaggccgtagcggttgggatcgccgtgggcggtgccggcggtgccggcggcgccgcccccaccggtaacggtggcgctggcggcaacggcggcgacgccctcggactagtcggcgtgggtgggaacggcggcaacgccggcaccggcttcggggctaacaccggcggcaacggcggcgacacgacgatagttgtcaacggcatgctcgccccgtctaccctcggctacggtggcaacggcggcaacggcgtcaacggcggagccggcggtaccggtggcaaggccggggtgtttggcgcgccgggacagaacggcttgccataa

SEQ ID NO: 127 - DNA, 654 bp, Mycobacterium Tuberculosis
atgctcgtcggggcacagtgccgcgatctactgcactggcgcttctgccgcggggtgccgccgcgggccaccaacgacaccgatatcgcagggaccctgaacaattgggaccacttcgaggcaattcgggccaccttccgcgccctgggcagcaccgggcaccgattcctgatcgccgaccgcgccgtcgatgccctcccgttcggcgaggtggagtcgcccaccggcacaacccgccatcccccaggcaaccagctcatgaacgtccacggatgcaccgacgcctacctgcgtgccgatgttctgcctctccctggcggcctgacagtccaccttccccaaccgccgaactatgcggtcctcaaactgcacgcatggctcgatcggtccgcggaccacgactacaaagacggcccagatctggccttggtggtgcactggtacgccggcgacctcgaccggctttacgccaaaccagaccagtgggcgctacgccgtcacgacttcgacctacgcaccgccgctgccgcgctgctcggccacgacatgcgcgccagtgtcagcgcaccggaggccgccgtgctggcgacgcgcgccacacaggccgaccacgacctgctggcccagcacttcgccgtgggtcgaccgggctag

SEQ ID NO: 128 - DNA, 651 bp, Mycobacterium Tuberculosis
atgagcaatccgcagccggagaaagtgcgcgtggtggtcggcgacgaccacccgttatttcgcgagggcgttgtgcgagcgctttcgttgagtggctcggtgaacgtggtcggcgaggccgacgacggcgccgcggccctggagttgatcaaggcccatttgcccgacgtcgcattgctggactaccgcatgcccggcatggacggcgcgcaggttgcggcggcggtgcgcagctacgagttgccaacccgggtgctgcttatttccgcgcacgacgagccggcgatcgtctaccaggcactccaacagggcgccgccggattcctgctcaaggattcgactcgcaccgagatcgtcaaggcggtgctcgattgcgcgaagggccgcgacgtggtggcgccctcgctggtcgggggcctcgccggggagattcgccagcgcgcggcacccgtggccccggtgctcagcgcgcgcgagcgcgaggtgctcaatcgcattgcgtgcggtcaaagcatccccgcgatcgcagccgagctatatgtggcgccgtcgacggtaaagacccacgtgcaacggttgtacgagaagctcggcgtcagcgaccgagctgccgcggtcgccgaggcgatgcggcagaggctgctcgactag

SEQ ID NO: 129 - DNA, 1515 bp, Mycobacterium Tuberculosis
atgcccgagctggccacgagcggtaacgccttcgacaagaggcggttcagccggcgcggcttcctcggcgccggcatcgccagcggctttgcgctagccgcttgcgcctcgaagcccacggcatccggcgccgccgggatgaccgctgcaatcgacgcggccgaggcggcccggccgcacagtgggcgaacggttaccgccacgctgaccccccagccggcgaggatcgacctgggtgggccgatcgtcagcacgctgacctacggcaacaccatccccggaccactgatccgggccaccgtcggggatgagattgtcgtctcggtgaccaaccgtctgggtgatccgacgtcggtgcattggcacggcatcgcgctgcgcaacgatatggatggcaccgagcccgcgactgcgaacatcggccccggcggtgactttacgtaccggttctccgtgccggatccgggcacctactgggcccatccgcacgtcggtcttcaaggcgaccacggcctatatctgcctgtcgtcgtcgacgatccgactgagccaggccactacgacgccgaatggatcatcatcctcgacgattggacggacggcatcgggaagtccccgcaacagctctacggcgagctgaccgacccgaacaaacccaccatgcaaaacacaacaggtatgcccgaaggcgaaggcgttgacagcaacctgctcggcggcgacggaggggacatcgcctacccgtactatctgatcaacgggcgaatccccgtggcggccacgtcttttaaggccaagcctggccagcgaatccggatccgcatcatcaacagcgccgccgacaccgcgttccgcatcgcgctggccgggcattcgatgacggtcacccacaccgacggttacccagtgattcccaccgaagtcgacgctctgctgatcggcatggccgaacgctacgacgtcatggtgaccgccgctggcggcgtctttcccctggtcgcactcgcggaaggcaagaacgcgctggcgcgtgcgctgctgtctaccggcgccggcagcccacccgacccgcagtttcggccggatgaactcaactggcgagtgggtaccgtggaaatgttcaccgccgcaacgactgccaacctgggccggcccgaacccacccacgacctcccggtcaccttgggcggcaccatggccaagtacgactggacaatcaacggggaaccctacagcacgaccaatccactgcacgtgcggctaggccaacggccaaccctgatgttcgataacaccaccatgatgtatcacccaatccacctacacggccatacctttcagatgatcaaggccgacggcagccccggcgcccgcaaggacaccgtgatagtgctgcccaagcagaagatgcgcgccgtcctggtcgccgacaatcctggcgtgtgggtgatgcactgccacaacaactatcaccaggtcgccggaatggcgacccgcctggactacattctgtga

SEQ ID NO: 130 - DNA, 393 bp, Mycobacterium Tuberculosis
gtggtgtggatgcgatcggcgattgtcgcggtcgcgctgggggtgacggtagccgccgtcgccgctgcatgctggctcccccagctccaccgtcatgtggctcacccaaaccacccgttgacgacgtccgtaggtagcgaattcgtcatcaacaccgaccacgggcacctggtggacaactcgatgccaccgtgcccggaacggctcgcgacggcggtgctgccgcgctccgccactccggtgttactaccagacgtcgtggcggctgcgcccggcatgacagccgcgcttaccgaccccgtcgcgccggccgcgcgcggtccgccggcggcgcagggatccgttcgcaccggtcaagacctgttgacccggttctgcctggctcgtcgctga

SEQ ID NO: 131 - DNA, 1224 bp, Mycobacterium Tuberculosis
atgagtggacgccaccgtaagcccaccacatccaacgtcagcgtcgccaagatcgcctttaccggcgcagtactcggtggcggcggcatcgccatggccgctcaggcgaccgcggccaccgacggggaatgggatcaggtggcccgctgcgagtcgggcggcaactggtcgatcaacaccggcaacggttacctcggtggcttgcagttcactcaaagcacctgggccgcacatggtggcggcgagttcgccccgtcggctcagctggccagccgggagcagcagattgccgtcggtgagcgggtgctggccacccagggtcgcggcgcctggccggtgtgcggccgcgggttatcgaacgcaacaccccgcgaagtgcttcccgcttcggcagcgatggacgctccgttggacgcggccgcggtcaacggcgaaccagcaccgctggccccgccgcccgccgacccggcgccacccgtggaacttgccgctaacgacctgcccgcaccgctgggtgaacccctcccggcagctcccgccgacccggcaccacccgccgacctggcaccacccgcgcccgccgacgtcgcgccacccgtggaacttgccgtaaacgacctgcccgcaccgctgggtgaacccctcccggcagctcccgccgacccggcaccacccgccgacctggcaccacccgcgcccgccgacctggcgccacccgcgcccgccgacctggcgccacccgcgcccgccgacctggcaccacccgtggaacttgccgtaaacgacctgcccgcgccgctgggtgaacccctcccggcagctcccgccgaactggcgccacccgccgatctggcacccgcgtccgccgacctggcgccacccgcgcccgccgacctggcgccacccgcgcccgccgaactggcgccacccgcgcccgccgacctggcaccacccgctgcggtgaacgagcaaaccgcgccgggcgatcagcccgccacagctccaggcggcccggttggccttgccaccgatttggaactccccgagcccgacccccaaccagctgacgcaccgccgcccggcgacgtcaccgaggcgcccgccgaaacgccccaagtctcgaacatcgcctatacgaagaagctgtggcaggcgattcgggcccaggacgtctgcggcaacgatgcgctggactcgctcgcacagccgtacgtcatcggctga

SEQ ID NO: 132 - DNA, 1953 bp, Mycobacterium Tuberculosis
atggcacagcaaactcaggtcaccgaggagcaagcgcgggcccttgccgaggaatctcgcgaaagtggttgggataaaccgtccttcgccaaagaactctttctgggccgctttcccttagggctcatacacccatttcccaagccgtcggacgccgaggaggcccgaaccgaggcgtttctggtcaaactgcgggaattcctcgacaccgtggacggcagcgtcatcgagcgtgctgcccagatccccgacgagtacgtgaaaggcctggccgagctgggctgtttcggcttgaagattccgtccgagtacggcgggttgaacatgtcgcaagtcgcctacaaccgcgtgctgatgatggtcacgacggttcattccagtcttggcgcgttgttgtcggcgcatcagtcgatcggggtacctgaaccgctcaagcttgccgggactgcggaacagaagcggcggttcctaccgcggtgtgcggccggcgcgatatcggcctttttactaaccgaacccgatgtgggctccgatccggcgcgcatggcatcgacggcgacgccgatcgatgacggccaggcttacgagcttgagggtgtgaagttgtggaccaccaacggtgtggtagcggacctgctagtggttatggcgcgggtaccgcgcagtgaagggcaccgagggggaatcagcgcctttgtcgtcgaggctgattcgcccgggatcaccgtggagcggcgcaacaagttcatgggactgcgtggcatcgaaaacggcgtgacccggcttcatcgcgtcagggtgcccaaagacaacttgatcggcagggaaggcgacggtctgaagatcgcgctgaccacactcaacgccggacggctgtccctaccggcgatcgcaaccggagttgcgaaacaggcgctgaagatagcgcgggaatggtccgtcgagcgagtgcaatggggcaagccggttggccaacatgaagcggtagccagcaagatctcgttcattgccgccaccaattacgcgctcgatgcggtggtcgagctgtccagtcagatggccgacgaaggccgcaacgacatccggatcgaggctgcgctggctaaattgtggtccagtgagatggcctgcctggttggcgatgagttgctacagatccgcggtggccgcggatacgagaccgccgaatccctcgccgcgcgcggtgagcgggcggtaccagtggagcagatggtgcgggacctgcggatcaaccggatcttcgaagggtccagtgagatcatgcggctgctcatcgcgcgtgaagcggtcgacgcgcacctcactgccgcgggtgatctggcgaaccctaaggccgatctgcggcagaaggccgcggcggcggccggcgccagcgggttctacgcgaagtggttgccgaagctggttttcggcgaaggccaactacccacgacgtaccgcgagttcggcgccctggcgacacatctgcgttttgtcgaacgctcgtcacgcaaattggcccgcaacaccttctacgggatggcgcgctggcaggccagcctggagaaaaagcaagggttcctcggccgcatcgtggatatcggcgccgagctattcgccatctccgcggcgtgtgtgcgcgccgaggcgcagcgaacggccgatccggtcgagggtgagcaggcatacgaactggccgaggcgttctgccagcaggccacgttgcgggtggaggcgctgttcgacgcgttgtggtccaacaccgacagcatcgacgttcggctggcaaacgatgtgctggagggccgctacacctggctggagcaagggatactcgatcagtccgaaggcaccggaccgtggatcgcgtcctgggaaccgggtccatccaccgaggccaatctggctcggcggttcttgacggtgtcgccatcgagcgaagcgaaactttag

SEQ ID NO: 133 - DNA, 489 bp, Mycobacterium Tuberculosis
gtgaagcgcggtgtcgcaacgctgccggtgatcctggtgattctgctctcggtggcggccggggccggtgcatggctgctagtacgcggacacggtccgcagcaacccgagatcagcgcttactcgcacgggcacctgacccgcgtggggccctatttgtactgcaacgtggtcgacctcgacgactgtcagaccccgcaggcgcagggcgaattgccggtaagcgaacgctatcccgtgcagctctcggtacccgaagtcatttcccgggcgccgtggcgtttgctgcaggtataccaggaccccgccaacaccaccagcaccttgtttcggccggacacccggttggcggtcaccatccccactgtcgacccgcagcgcgggcggctgaccgggattgtcgtgcagttgctgacgttggtggtcgaccactcgggtgaactacgcgacgttccgcacgcggaatggtcggtgcgccttatcttttga

SEQ ID NO: 134 - DNA, 789 bp, Mycobacterium Tuberculosis
gtgaccgggcccaccgaggagtctgccgtggcgactgtggccgactggcccgaggggttagcggcggtgctcaggggtgcggccgaccaagccagggccgccgttgtggagttcagcggcccggaggcggtgggagactacctgggcgtcagctacgaggatggcaacgccgccacccaccggttcatcgcgcatctgcctggctaccagggatggcaatgggccgtcgtggtggcgagctattccggtgcggaccatgccacgatcagcgaggtggtgctggtcccggggcctaccgcactgctggcgccggattgggtgccgtgggagcaacgggtgcggccgggagacttgagccccggagatctgctggcgccggcgaaggatgatccgcggctggttccgggttacaccgccagtggtgatgcgcaggttgacgagaccgccgcagagatcgggttgggtcggcgctgggtgatgagcgcctggggtcgcgcccagtcggcccaacggtggcacgacggcgactatggtcccggctctgctatggcgcggtcgacgaaacgcgtctgccgcgactgcggtttcttcctgccgctggccgggtcgctgggcgcaatgttcggggtatgtggtaacgaactgtccgctgacgggcatgttgtcgataggcaatacggctgtggcgcccattccgacaccactgcgccggccggtggcagcacacccatttatgagccgtacgacgacggtgtgctcgacatcatcgagaagccggctgaatcatag

SEQ ID NO: 135 - DNA, 1122 bp, Mycobacterium Tuberculosis
atgacagtggtcccggagaatttcgtccccggcctcgacggcgtggtggcctttacgaccgagatcgccgagccggacaaagacggcggggccctgcgctaccgtggcgtcgacatcgaagacctggtaagtcagcgggtcaccttcggcgatgtgtgggcgctgctggtggacggcaacttcggcagcgggctgccgccggctgaaccgttcccgctgccgattcactccggcgatgtgcgcgtcgacgtccaggccggcctggcgatgctggcgcccatctggggatatgcgccgctgctcgacatcgacgacgccaccgcccgccaacagctggcccgggcatcggtgatggcgctgtcctatgtcgcgcaatccgcacggggcatctaccagccggcggtcccgcagcgaatcatcgatgaatgctcgacggtcacagcacgtttcatgacgcgctggcagggcgagccagaccccagacacatcgaggccattgacgcctactgggtgtcggccgccgagcacggcatgaacgcttcgacattcaccgcgcgtgtgatcgcctcaactggggcggatgtggcagcagcgctgtcgggcgcaatcggggcgatgagcggaccgctgcatggtggcgcgccggcgcgcgtcctgccgatgctcgacgaggtcgaacgcgccggcgatgcccgcagcgtggtcaagggaatcctggaccgcggcgagaaactgatggggttcgggcaccgggtctaccgcgccgaggacccgcgggcgcgggtgctgcgggcggccgccgagcggctgggcgccccccgctacgaggtcgcggtcgcggtggagcaggctgcgctgtcagaactgcgagagcgccgtccggatcgggcgatcgagaccaatgtcgaattctgggccgcagtggtcctggactttgcccgggtaccggccaacatgatgccagcaatgttcacctgtgggcgcactgccggctggtgtgcccacattctcgagcagaagcgactcggcaagctggtccgcccgtcggccatttacgtgggaccgggcccgcgcagcccggaatcggtcgacggctgggagcgggtactcaccaccgcctga

SEQ ID NO: 136 - DNA, 153 bp, Mycobacterium Tuberculosis
atggattttgtgatccagtggtcgtgctacctgctggcgttcctggggggctcggctgttgcctgggtagtcgtcactctgtcgatcaagcgcgccagccgtgatgagggtgctgcggaggcgcccagtgcagccgagacaggcgcacagtga

SEQ ID NO: 137 - DNA, 528 bp, Mycobacterium Tuberculosis
atggaacacgtgcactggtggctggcgggcctggcgttcacgctcgggatggtgctgacgtcgacgctgatggtccggcccgtcgaacatcaagtgctggtaaagaaatcggtccgcgggtcaagcgctaagtccaagccgccaacggcgagaaaacccgccgtcaagtcgggcaccaagagagaggagtcgccgacggcgaagaccaaggtggcaacggagtctgctgcggagcagatcccggttgccggggagcccgcggcggagccgatcccggtcgccggcgagccggcggcgcgtattccggtggttccgtacgcgccgtacggcccgggctcggcgcgcgctggtgccgatggcagcggaccgcaggggtggctggtgaagggccgctcggacaccaggctctactacactcccgaagatccgacgtacgaccctactgtcgcccaggtttggttccaggacgaggagtcggcagcgcgggcgtttttcacgccgtggcgcaagagcacacggcggacatga

SEQ ID NO: 138 - DNA, 1119 bp, Mycobacterium Tuberculosis
atggtgcgccgagcgctacgactggcggccggcaccgcctcgctggccgccggcacgtggctgttgcgtgcgctgcacggcacgccggccgcgctcggtgccgacgcggcgtcgatcagggctgtgtcggagcaatcgccgaactatcgtgacggcgccttcgtcaacctggatcccgcgtcgatgttcaccctggatcgcgaggagcttcggctcatcgtgtgggagttagtggccagacacagtgcgagccggccggcggcgccgatcccgttggcctcgccgaatatctaccggggtgacgccagccggctcgccgtcagctggttcggtcactcgacggcgctgctggaaatcgacggctaccgggtgcttaccgatccggtgtggagcgatcggtgctcaccgtccgacgtcgtcggcccccagcgcctgcatccgccgccggtgcaactggcagctctcccggccgtcgacgccgtggtcatcagccacgaccactacgaccatctcgatatcgacaccgtggttgcgctggtcggcatgcaacgggccccgttccttgtgccgctcggggtcggcgcccaccttcggtcgtggggtgttccgcaggatcgcattgttgagctcgactggaaccagagcgctcaggtcgatgagctcaccgtggtctgcgtgccggcacggcacttctcgggacggttcctgagccgcaacaccacactgtgggcctcgtgggcgtttgttgggccgaaccatcgcgcctacttcggcggtgataccggatacaccaagagcttcacccagatcggcgcggaccacggaccgttcgacctgaccctgctgcccatcggggcctacaacacggcgtggccggacatccacatgaaccccgaggaggcggtccgggcgcacctggacgtcaccgattcgggctcgggaatgctggtgccggtgcactggggcaccttccggctggccccccatccgtggggcgagccggtcgagcggctgctcgcggcggctgaacccgagcacgtcacggtagccgtgccgctacccggtcagcgggtcgacccgaccgggcccatgagattgcacccatggtggcggctgtaa

SEQ ID NO: 139 - DNA, 975 bp, Mycobacterium Tuberculosis
gtggtcaccgagccgctcacaaagccggcgctagtggcggtcgacatgcgccccgcgcggcgcggcgagcggctgttcaagctggccgcgtcggccgccggttcgacgatcgtcatcgcaatcctgctgatcgcgatattcctgttggtccgcgccgtgccgtcgttgcgggcgaatcacgccaatttcttcaccagtacccaattcgacacgtcggacgatgagcagctggcgtttggtgtccgggacttgttcatggtcacggcgttgagttcgataacggctctggtgttggcggtgccggtggctgtcgggatcgcggtgttcctcacccactacgcgccgaggagactgtcgcgtccattcggcgcgatggtggatctactggccgcagtgccgtcgatcatcttcgggttgtgggggatctttgtgctggcgcccaagctcgagccgatcgcgaggtttctcaatcgcaacttgggctggttgttcctgtttaagcagggcaacgtgtcgttggccggcggcggcacgattttcaccgcgggcatcgtgctgtcggtgatgatcctgcctatcgtcacatcgatatcacgcgaagtgttccggcagactccgctgatccaaatcgaagcagcgctggcgctaggcgcgacgaaatgggaggtagtgcggatgaccgtgctgccatacgggcgaagcggggtggtcgcggcctccatgctgggtttggggcgggctctgggcgaaaccgtggccgtgctggtcatcctgcgctcggccgcgcggccggggacctggtcgctgttcgacggcggttatacgttcgcttccaagatcgcctccgctgcttcagaattcagcgaaccgctgccgaccggagcctatatttcggcgggatttgcgttattcgtgctgacgttcctggtcaatgcggccgctcgcgcaatcgccggcgggaaggtcaacgggtga

SEQ ID NO: 140 - DNA, 906 bp, Mycobacterium Tuberculosis
atgggcgaatcggctgagtccgggtcccggcagctaccggcgatgtccccgccgcggcgatcggtagcctatcggcgcaagatcgtcgatgccctgtggtgggcggcgtgcgtgtgttgtctggcggtggtgatcaccccgacgttgtggatgttgatcggagtcgtcagccgcgctgtaccggttttccactggagtgtgctggtgcaggactcccagggcaatggcggcggcttgcgcaacgccatcatcggtaccgcagtgttggccatcggggtgatcctggtgggtggcacggtgagtgtgttgaccgggatttatctgtccgaattcgccaccggcaaaacacggtccattctgcgcggcgcctacgaggtgttgtccggtattccgtcgatcgtgctcggctacgtcggctatttggccctggtggtgtacttcgattgggggttttcgctggcggccggggtgttggtgctgtcggtgatgagcattccctacatcgccaaggccaccgagtccgcgctggcccaggtgccgacgtcgtatcgggaagcggctgaggcactcgggttaccagccggctgggcgctgcgcaagatcgtgctgaagacggcgatgcccggaatcgtcaccgggatgttggtcgcgctggccctggcgatcggcgagacggcgccgctgctgtacacggcggggtggtcgaattcgccgccgaccggacaactcaccgactcgccggtcggctacctgacctacccaatttggacgttctacaaccagccatccaagtcggctcaggatctgtcctatgacgcggctctcttgctgatcgtgttcctgctgctattgatcttcattggccggttgatcaactggctgtcacggaggcgttgggacgtttga

SEQ ID NO: 141 - DNA, 2280 bp, Mycobacterium Tuberculosis
atgggttcggcgtcggagcaacgggtgacgctgaccaacgccgacaaggtgctctatcccgccaccgggaccacaaagtccgatatcttcgactactacgccggtgttgccgaagtcatgctcggccacatcgcgggacggccggcgacgcgcaagcgctggcctaacggcgtcgaccaacccgcgttcttcgaaaagcagttggcgttgtcggcgccgccttggctgtcacgtgcaacggtggcgcaccggtccgggacgacgacctatccgatcatcgatagcgcaaccgggctggcctggatcgcccaacaggcggcgctggaggtgcacgtgccgcagtggcggtttgtcgccgagcccggatcaggtgagttaaatccgggcccggcaacgcgtttggtgttcgacctggacccgggcgaaggcgtgatgatggcccagctggccgaggtggcgcgcgcggttcgtgatcttctcgccgatatcgggttggtcaccttcccggtcaccagcggcagcaagggattgcatctgtacacaccgctggatgagccggtgagcagcaggggagccacggtgttggccaagcgcgtcgcgcagcgattggagcaggcgatgcccgcgttggtcacctcgaccatgaccaaaagcctgcgggccgggaaggtgtttgtggactggagccagaacagcggctcgaagaccaccatcgcgccgtactcactacgtggccggacgcatccgaccgtcgcggcgccacgcacctgggcggagctcgacgaccccgcactgcgtcagctctcctacgacgaggtgctgacccggattgcccgcgacggcgatctgctcgagcggctggatgccgacgctccggtagcggaccggttgacccgataccgccgcatgcgcgacgcatcgaaaactcccgagccgattcccacggcgaaacccgttaccggagacggcaatacgttcgtcatccaggagcatcacgcgcgtcggccgcactacgatttccggctggaatgcgacggcgtgctggtctcgtgggcggtaccgaaaaacctgcccgacaacacatcggttaaccatctagcgatacacaccgaggaccacccgctggaatacgccacgttcgagggcgcgattcccagcggggagtacggcgccggcaaggtgatcatctgggactccggcacttacgacaccgagaagttccacgatgacccgcacacgggggaggtcatcgtgaatctgcacggcggccggatctctgggcgttatgcgctgattcggaccaacggcgatcggtggctggcgcaccgcctaaagaatcagaaagaccagaaggtgttcgagttcgacaatctggccccaatgcttgccacgcacggcacggtggccggtctaaaggccagccagtgggcgttcgaaggcaagtgggacggctaccggttgctggttgaggctgaccacggcgccgtgcggctgcggtcccgcagcgggcgcgatgtcaccgccgagtatccgcaattgcgggcattggcggaggatctcgccgatcaccacgtggtgctggacggcgaggccgtcgtacttgactcctctggtgtgcccagcttcagccagatgcagaatcggggccgcgacacccgtgtcgagttctgggcgttcgacctgctctacctcgacggccgcgcgctgctaggcacccgctaccaagaccggcgtaagctgctcgaaaccctagctaacgcaaccagtctcaccgttcccgagctgctgcccggtgacggcgcccaagcgtttgcgtgctcgcgcaagcacggctgggagggcgtgatcgccaagaggcgtgactcgcgctatcagccgggccggcgctgcgcgtcgtgggtcaaggacaagcactggaacacccaggaagtcgtcattggtggctggcgcgccggggaaggcgggcgcagcagtggcgtcgggtcgctgctcatgggcatccccggtccaggtgggctgcagttcgccgggcgggtcggtaccggcctcagcgaacgcgaactggccaacctcaaggagatgctggcgccgctgcataccgacgagtcccccttcgacgtaccactgcccgcgcgtgacgccaagggcatcacatatgtcaagccggcgctggttgcagaggtgcgctacagcgagtggactccggagggccggctgcgtcaatcaagctggcgtgggctgcggccggacaagaaacccagtgaggtggtgcgcgaatga

SEQ ID NO: 142 - DNA, 477 bp, Mycobacterium Tuberculosis
gtggccgggacgccgcagccgcgcgcgctcgggcccgatgcgctggacgtcagcaccgacgacctggccgggctgttggccggcaacaccggccggatcaagaccgtcatcaccgaccagaaggtaattgccggcatcggcaacgcctatagtgacgaaatcctgcacgtcgcgaagatctcgccgttcgccacggccggcaagttatccggcgcacagctcacctgcctgcatgaggcgatggcgtcggtgctgtcggacgcggtgcgccggtccgtcggccagggcgcggccatgctcaaaggggagaaacgttctgggcttcgagtacatgcgcgcaccgggttaccctgcccagtgtgcggtgacaccgtgcgggaggtgtccttcgcggacaagtcttttcagtactgtccaacgtgtcagaccggtggcaaggcgctggccgaccggcgtatgtcgcggctgctcaagtag

SEQ ID NO: 143 - DNA, 1662 bp, Mycobacterium Tuberculosis
atgacctccgcgccaatccccgacatcaccgctaccccggcatgggacgccctgcgcagacatcacgatcagatcggaaacacccatcttcgccagttcttcgccgacgatccgggtcgcggccgggagctcaccgtcagcgtcggcgatctctacatcgactacagcaaacaccgcgtcacccgcgagacgctggcgctgctgatcgatctggcccggacggcccacctcgaagagcgtcgcgaccagatgttcgccggtgtgcatatcaacacctctgaggatcgagcggtgttgcacaccgcgctgcggctgccccgagacgccgaactcgtcgtcgacggccaagacgtcgtcaccgacgtacatgccgtgctcgacgcgatgggcgccttcaccgaccgcctgcgcagcggcgagtggaccggagcaactggaaagcggatcagcaccgtcgtcaacatcggcatcggtggttcggatttgggtccggtgatggtgtaccaagcgttgcgccactatgccgacgcgggcatttccgcgcgcttcgtgtccaacgtcgatcccgccgacctgatcgccacgctcgccgatctagaccccgccacaacgcttttcatcgtcgcgtcgaagacgttctcgacgctggagacattgaccaatgcgaccgcggcgcgtcgctggctgaccgatgcgctgggcgacgccgcggtgtcgcggcattttgtcgcggtgtccaccaacaagcgcctggtcgacgacttcggcatcaacaccgacaacatgttcggtttttgggattgggtcggcgggcgttattcggtggattcggcgatcgggctgtcgttgatgacggtgatcggccgcgacgccttcgccgatttcttggccggattccacatcatcgaccgccatttcgcgaccgctccgctggaatccaacgcgccggtgctgcttggcctgatcggactgtggtactccaatttcttcggtgcgcaatcacgcaccgtgctgccgtattccaatgacttgtcgcgttttccggcctaccttcagcagttgaccatggaatccaacggcaagtccacgcgcgccgacggcagcccggtcagcgccgacaccggtgaaatcttttggggtgaaccgggaaccaacggccagcacgccttctaccagttgctgcaccagggcacccggctggtgccagccgatttcatcggctttgctcaacccctcgacgacctgccgaccgccgagggcaccggcagcatgcatgatctgctgatgagcaacttcttcgcccaaacccaggtgctggcgttcggcaagaccgccgaggagatcgccgccgacggcacccccgcccacgtggtagcgcataaggtgatgcccggcaaccggccgtccacctcaattctggccagtcggctcacgccgtcggtgctggggcagttgatcgcgctctacgagcatcaggtgttcaccgagggtgtggtgtggggtatcgactcgttcgaccagtggggggtggagctgggcaagacgcaggccaaggcgctgcttccggtaatcaccggcgccggttcaccgccaccgcagtcggacagctcgaccgacgggctggtgcgccgctaccgcaccgaacgtggccgcgcgggctag

SEQ ID NO: 144 - DNA, 1380 bp, Mycobacterium Tuberculosis
atgtcacccagtaacctgccccgcaccgtgggcgagctgcgtgccgccggtcatcgggaacggggggtcaagcaggaaatccgggaaaatctgctgaccgcgctggccgacggcgacaacgtctggccgggcatcctgggtttcgacgacaccgtgattccccaggtggagcgggccttgatcgccggtcacgactttgtcctgctcggcgaacgcggccagggcaagacccggctgctgcgcgcactcgcgggtctgctggacgagtggacgccggtgatcgccggcgccgaactgggcgagcacccctacacgccgatcacgccggagtcgatccggcgggccgcgcagctcggcgacgacctaccggtggcgtggaagcaccgcagcgagcgctacaccgagaagctggccacccccgacaccagcgtcgccgacctggtcggcgacgtcgacccgatcaaggttgccgagggccgcagcctcggggatcccgaaaccatcgcctacgggctcatcccgcgggcgcaccgcggcatcgtcgcggtcaacgagctgcccgacctcgccgaacgcatccaggtgtcgatgctcaacgtcatggaggagcgcgacatccaggtccgcggctacacgctgcggctgccgctggatgtgttggtggtcgccagcgccaaccccgaggactacaccaaccgtggccgcatcatcacgcccatcaaggaccggttcggcgccgagatccgcacccactacccactggagctggaggcggagatgggcgtcatcgtccaggaggcgcacctgagtgcacaggtgtccgactacctgatgcaggtgctcgcgcggtttgcccgttacctgcgagaatcccgctcgatcgatcagcgctccggggtgtcggcgcggtttgccatcgcagcggccgaaaccgtggcggctgccgcccggcaccgcggggcggtgctgggggagacagacccggtggcccgggtggtcgatttgggcacggtgatcgacgtgctgcgcggcaagctggaattcgagtccggcgaggagggccgcgaacaggcggtgctcgagcatctgttgcgtcgcgccaccgccgataccgcgtcccgggtgctgggcggtatcgacgttggctcgttggtgaccgcggtcgagggcggttcggcggtgacgacgggcgagcgggtctcggccaaggatgtgctggcggcggtgccgggcctgccggtggtggacaggatcgcgcgcaagctgggcgccgaatccgagggggagcgtgccgcggcactggaactggcgttggaggcgctatacctggccaagcgcgttgacaaggtctgcggggagggccagaccgtctatggctaa

SEQ ID NO: 145 - DNA, 2019 bp, Mycobacterium Tuberculosis
atggctaagtctgatggtgacgacccgctgcgcccggcttcgccgcgcttgcgatcgtcacgacggcactcgctacgctactcggcgtacaccggcgggcccgacccgctggccccgccggtggatctgcgggatgcgctggaacagattggccaagacgtcatggcgggcgcctcgccgcgccgggcgctgtccgagctgctgcggcggggcaccaggaacctgaccggcgccgaccggctggcggccgaggtgaaccgccgccgacgggagttgttgcgccgcaacaacttagatggcaccttgcaggagatcaagaagctgctcgacgaggccgtgctggccgaacgcaaggagctggcccgcgcgctagacgacgacgcccgcttcgccgagctgcagctggacgcgcttccggcctcgccggccaaggcagtacaggagctggccgaataccgctggcgcagcgggcaggcccgcgaaaagtatgagcagatcaaggatttgctcggccgtgagctgctcgaccaacgctttgccggcatgaagcaggcgcttgccggtgccaccgacgacgatcgccggcgggtcaccgagatgctcgacgacctcaacgacctgttggataagcacgcccgcggtgaagatacgcagcgggacttcgacgagttcatgaccaagcacggcgagttcttcccggagaacccgcgcaacgtcgaggagctgctggactcgctggccaagcgagccgccgccgcgcagcggttccgcaacagcctgagccaggaacagcgggacgagctggacgcgttggcgcagcaggcatttggctctccggcgttgatgcgggcgctggaccgtttggatgcgcatctgcaggccgcccgtcccggcgaagactggaccggctcgcagcagttctccggtgataatccgttcggcatgggggaaggcacccaggcgctggccgacattgccgagctggagcagctggccgagcagctgtcgcagagctatccgggcgccagcatggacgatgtcgacctggacgcgctggcccgtcagctcggcgaccaggccgccgtcgacgcccggacgctggctgaattggaacgcgcgctggtcaatcagggcttcctggaccgcggttccgacggccagtggcggctctcgccgaaggccatgcgccgcctcggcgaaacggcgttacgcgatgtggcgcaacaactttccgggcgccacggcgagcgtgatcaccggcgtgccggcgccgcgggcgagctgaccggtgcgacgcggccctggcagttcggcgacaccgagccgtggcacgtcgcccgcacgctgaccaatgccgtgctgcgccaagccgcggccgtgcatgaccgcatccggatcaccgtcgaggatgtcgaggtcgccgagaccgaaacgcgcacccaggccgctgttgcgttgttggtggacacctcgttttcgatggtgatggagaatcgctggttgccgatgaagcgcacggcgctggcgctgcaccacctggtgtgcacccggttccgctcggatgccttgcagatcatcgcgtttgggcgctacgcccgcacggtgacggcggccgagctgacggggttggcgggtgtctacgagcagggcaccaacctgcaccatgcgctcgcgctggccggccggcacctgcgccggcacgcaggcgcccagcccgtggtgctggtggtgaccgacggcgagccgaccgcccacctggaggacttcgacggcgacggtacgtcggtgttctttgattacccgccccatccgcgcaccatcgcccacaccgtgcgcgggtttgacgacatggcgcggctgggtgcgcaggtgacgatcttccggttgggcagtgaccccggtctggctcggttcattgaccaggttgcgcgacgggtgcagggccgcgtggtggtgcccgatctcgacgggctgggcgcggcggtggtgggcgactacctgcgcttccggcggcgctag

SEQ ID NO: 146 - DNA, 546 bp, Mycobacterium Tuberculosis
atgaaggtcgccgcgcagtgttcaaagctcggatatacggtggcacccatggaacagcgtgcggagttggtggttggccgggcacttgtcgtcgtcgttgacgatcgcacggcgcacggcgatgaagaccacagcgggccgcttgtcaccgagctgctcaccgaggccgggtttgttgtcgacggcgtggtggcggtgtcggccgacgaggtcgagatccgaaatgcgctgaacacagcggtgatcggcggggtggacctggtggtgtcggtcggcgggaccggggtgacgcctcgcgatgtcaccccggaagccacccgcgacattctggaccgcgagatcctcggtatcgccgaggccatccgcgcgtccgggctgtccgcgggaatcgtcgacgccgggttgtcgcgcggcctggcgggtgtctccggcagcacgctggtggtcaacctcgcgggttcgcgttatgcggtgcgcgatggaatggcgacgctgaatccgctagcggcacagatcatcgggcagttgtcgagcttggagatctga

SEQ ID NO: 147 - DNA, 333 bp, Mycobacterium Tuberculosis
gtgccaacctacagctacgagtgcacccagtgcgccaaccgcttcgatgttgtgcaggccttcaccgacgatgcgctgaccacgtgcgagcggtgttctggccggctgcgcaagctgttcaatgcggtcggcgtggtgttcaaaggcaccggcttctaccgcaccgacagccgcgagtcgggcaagaagtccaagagccagaccaacggatcctcgaccagcgagtcgacgaagagttcggggagttcggggagttctggctcgagtgaaagcaaggcttcggggtcaaccgagaagtcaaccagctccacaaccgccgccgcggccgtctga

SEQ ID NO: 148 - DNA, 921 bp, Mycobacterium Tuberculosis
atgtcacgcccagaagtactaacgccgttcacggcaatcgtcccggcagccggcctgggtacgcgctttctgccggccaccaagacggtgcccaaggagctgctgcccgtcgtcgacactcccggtatcgagctggtggccgccgaggcggccgcggccggtgccgaacggctggtgatcgtcacctccgagggtaaggacggggtggtcgcgcatttcgtggaagacctggtgctggagggcacgctcgaggcccgaggcaagatcgccatgctggccaaggtgcgtcgcgccccggcactgatcaaggtcgaatccgtggtgcaggccgagccgctgggactgggacacgccatcggctgtgtggagccgacgctgtcgcccgacgaagacgctgtcgcggtgctgctgcctgacgacctggtgctgccgaccggcgtcctggagacgatgtcgaaggtgcgagccagcaggggcggcaccgtgctgtgtgctatcgaggtggcgcgcgaggagatcagtgcctacggggttttcgatgtcgagccggtccccgatggtgactacaccgacgatcccaacgtgctgaaggtcaggggcatggtcgaaaagcccaaggccgaaacggcgccgtcgaggtatgcggcggccggccgctacgttctagaccgtgccatcttcgatgcgttacgccgcatcgaccagggtgcaggcggtgaagtgcagctcaccgatgcgatcgcgctgctgattgccgagggccatcccgtccatgtcgtcgtccaccaagggtcccgacacgacctgggaaatccgggcgggtacctcaaggctgcggttgactttgcattggatcgtgacgactacggcccggacttgcggcgatggttggtggcgcgactgggtctgacagagcagtag

SEQ ID NO: 149 - DNA, 1002 bp, Mycobacterium Tuberculosis
ttggacgggatagccgaattgaccggcgcacgagtcgaagatcttgcggggatggacgtctttcagggatgtccggccgagggtctggtgtcattggcggcgagcgttcagccgttgcgggccgctgccggccaggtgctgctgcggcagggcgagccggcggtttcgtttctgcttatctcgtcgggtagcgcagaagtcagccatgttggcgacgatggtgttgcgatcatcgctcgggcgctgccgggcatgatcgtcggcgaaatcgcgctgctgcgcgatagcccgcgcagcgcgacggtcaccaccatcgagccgctgaccggctggacgggtggccgcggcgctttcgccacaatggtgcacatccccggggtcggtgagcgattgctgcgcaccgccaggcagcgtctcgccgccttcgtctccccgattccggtacggcttgccgacgggactcaactgatgctacgccccgtgctgcccggtgaccgcgagcggaccgtgcacggacacatccagttctccggcgagacgctgtatcgacggttcatgtcggctcgtgttcccagtccggcgttgatgcactacctgtcggaagtcgactacgtcgaccacttcgtctgggtggtgaccgacggaagcgaccccgtagccgacgcgcgttttgtgcgggatgaaaccgatccgacggtcgccgagatcgcgttcacggttgccgacgcgtatcagggcagggggattggaagctttctcatcggtgcgttgtccgtggccgcccgggtcgacggcgtcgaaaggtttgccgcgcgcatgctttccgacaatgtgccgatgcgaacgatcatggaccgctacggggcggtgtggcagcgcgaggacgtcggagtcatcaccaccatgatcgatgtgccgggtccgggtgagctgagcttggggcgcgagatggtcgaccagatcaaccgggtagcccggcaagtgatcgaggccgtcggctga

SEQ ID NO: 150 - DNA, 618 bp, Mycobacterium Tuberculosis
atgtgcgataagcttggcggcgtggcgatcgcggttcaaggcgcgctcttcgagcacaacgagcgaagacagctcggcgacggagcctttatcgacatccgttcgggctggctgaccggcggcgaagaactgctggacgcgttgttgtcgacggtgccgtggcgagccgagcgccgtcagatgtacgaccgggtggtcgatgtgccgcggctggtgagttttcacgacctgaccatcgaagatccgccgcatccgcagctggcgcggatgcgccggcggctcaacgacatctacggcggcgaactgggtgagcccttcaccaccgccgggctgtgctactaccgcgacggctctgacagcgtcgcctggcatggcgacaccattggtcgcggcagcactgaggacactatggtggcgatcgtcagcctcggcgccacccgcgtcttcgcgctgcggccgcgtggccgcggtccatcgttgcgactgccgttggcgcatggcgatctattggtgatgggcggatcgtgtcaacgcaccttcgagcatgcggtgcccaagacatcggcgccgacgggtccgcgcgtgagcatccagttccggccgcgcgacgtccgctaa

SEQ ID NO: 151 - DNA, 858 bp, Mycobacterium Tuberculosis
atgtcctctggtcgcctgttgctcggcgccaccccgctgggccagccgtcggatgcgtcaccacgcctggcggccgcgttggccaccgccgatgtggtggcggccgaggacacccggcgggtgcggaaattggccaaggctcttgacatccggattggtggacgggtggtcagcctgttcgaccgggtggaggcgttgcgcgtgacggcccttctcgacgcgatcaataacggtgcgacggtgctggtggtcagtgacgccgggaccccggtgatcagcgatcccggctatcggctggtcgcggcgtgcatcgacgcgggggtttcggtgacgtgtttacccgggccgtccgcggtgaccaccgcgctggtgatgtccggtctgccggcggagaagttctgcttcgagggtttcgccccgcgcaagggtgcggcgcgccgggcctggctggccgaactggccgaggagcggcgcacctgtgttttcttcgaatccccgcgccggttggctgcgtgccttaacgatgccgtcgagcagctcggtggtgcccgtccggcggcgatctgccgggagctgaccaaggtgcatgaggaagtggtgcgcggatcgcttgacgagttggcgatctgggcggccggtggtgtgctcggcgagatcaccgtggtggtggcgggcgccgccccccacgccgaactgtcgtcgctgatagcccaagtggaggagttcgtcgcggcgggtattcgtgtcaaggacgcctgcagcgaggtagcggcggcacatccgggggtgcgcacccgccagctttacgacgcggtgctgcaatcacggcgggaaaccggcgggccagcgcagccgtag

SEQ ID NO: 152 - DNA, 93 bp, Mycobacterium Tuberculosis
atgactacggtcgacaacatcgtcgggttggtgatcgcggtggcgctaatggcgttcctattcgcggcgctgctgtttccggagaagttctga

SEQ ID NO: 153 - DNA, 2130 bp, Mycobacterium Tuberculosis
gtgatgatcgcacgcatggagacctccgcaaccgccgcggcagcgacgtcggcaccccggctccggctggccaagcgctcgctgttcgatccgatgattgtgcgctcggcgctgccccagagcctgcgcaagctggctccgcgggtacaggcccgtaacccggtcatgttggtcgtgctggtcggtgccgtgatcaccacactggcgttcctgcgcgacctcgcatcctcgacagcccaagagaacgtcttcaacggtctggtcgccgcgttcctctggttcaccgtcctgtttgccaactttgccgaggccatggccgaaggacgcggcaaggctcaggcggcggcgctgcgcaaagtccggtccgaaacgatggccaaccggcgcacggctgcgggcaacatcgaatcggtcccttcgtcgcggctggacctcgacgacgtggtggaggtttcggctggcgaaacgatcccgtcggacggcgagatcatcgaaggcattgcctccgtcgacgagtctgcgatcaccggcgaatcggcaccggtgatccgcgagtcgggcggcgaccgttccgcggtgacgggtggcaccgtggtgctgtcggatcggatcgtcgtgcggatcaccgccaagcagggacaaacattcatcgaccggatgatcgcgctggtggagggcgccgcacggcagcagacaccgaacgagatcgcgctgaacatcctgctggctgggctgacgatcatctttttgctcgcggtggtgacgctgcagccgttcgccatctattccggcgggggacagcgggtggtcgtgctggtggcgttgctggtgtgtctcattccgaccacgatcggtgcgctgctgtccgcgatcggcatcgcggggatggaccggctggtgcaacacaacgtgctcgccacatctgggcgggcggtggaggcggccggcgacgtgaacacgctgctgctggacaagaccggcaccatcaccctcggtaaccggcaggccaccgagttcgtgccgatcaacggtgtgagtgccgaggcggtcgccgacgccgcccagctgtcgagcttggccgacgaaactccggagggccgctcgatcgtcgtgctggcgaaggacgagttcgggctgcgcgcccgcgacgagggcgtgatgtcacacgccaggttcgtgccgttcaccgccgaaacccggatgtccggggtcgatctcgccgaggttagcggcatccgtcggatccgcaagggtgccgcggctgcggtgatgaagtgggttcgcgatcacggtggccaccccaccgaggaggtgggtgccattgtcgacggcatcagctccggcggggggacacccctagtcgttgcggaatggaccgataacagcagcgcgcgggccatcggcgtcgtccatctgaaggacatcgtcaaggtgggcatacgggaacgcttcgacgaaatgcgccgaatgagcatccgcaccgtgatgatcaccggtgacaacccggcgaccgccaaggcgattgcacaggaggccggcgtcgacgatttcttggccgaggccacgcccgaggacaagcttgcgctcatcaagcgcgaacagcagggcggtcggctggtcgccatgacgggtgacgggaccaatgacgcacccgcgctcgcgcaagccgatgtcggggtggcgatgaataccggcacccaggcggcccgggaagccggcaacatggtcgatctcgactccgaccccaccaagctcatcgaggtcgtggagatcggcaagcagctgctgatcacgcggggcgcgctgacgacgttttcgatcgccaacgacgtcgcgaagtacttcgccatcatccctgccatgttcgtcggcctgtatccggtgctcgacaagctgaacgtcatggcgctgcactcaccaaggtcggcgattctgtcggcggtcatcttcaatgcgctggtgatcgtcgccttgatcccattggcgttgcggggcgtgcggtttagggcggaaagcgcgtcggcgatgctgcggcgcaacctgctgatctatgggctgggcggtctcgtcgtcccgtttatcggcattaaactggtcgatctcgtcatcgtcgccctcggggtgtcctga

SEQ ID NO: 154 - DNA, 339 bp, Mycobacterium Tuberculosis
ttgatccccggtcggatggtgctgaactgggaagatggcctcaatgcccttgttgcggaagggattgaggccatcgtgtttcgtactttaggcgatcagtgctggttgtgggagtcgctgctgcccgacgaggtgcgccgactgcccgaggaactggcccgggtggacgcattgttggacgatccggcgttcttcgccccgttcgtgccgttcttcgacccgcgcaggggccggccgtcgacgccgatggaggtctatctgcagttgatgtttgtgaagttccgctaccggctgggctatgagtcgctgtgccgggaggtggctgattcgatcacctga

SEQ ID NO: 155 - DNA, 882 bp, Mycobacterium Tuberculosis
gtgaccaagccctattcgtcgccgccaacgaacctgcgctcactacgagatcggctcacccaagtagcggaacggcaaggtgtcgtgttcggtcgactgcagcggcatgtcgcgatgattgttgtcgcacagttcgcggccacgctcaccgacgacaccggcgctccgctgctgttggtcaaaggcggatcgtcgctggaactgcgccggggaattcccgattcgcggacctccaaagacttcgacacggtcgcacgtcgcgatatcgaattaatccatgaacagctcgctgacgcgggcgagacggggtgggaaggattcactgcaatcttcaccgcccccgaagaaatcgatgttcctggtatgccggtcaagccgcgccgattcaccgccaagctgagctaccgaggccgggctttcgcaactgttccgatcgaggtctcctccgtcgaagccggcaatgccgaccaattcgacaccctcacctcagacgcgctcggcctcgtgggcgtacccgcagcagtcgccgtaccctgcatgaccattccctggcaaatcgcgcagaagctgcacgcagtaactgccgtgctcgaagaaccgaaggtcaacgaccgcgctcacgacctggtggacttgcagcttcttgaaggactgttgctcgatgccgacctcatgccgacgcgcagcgcgtgcatcgcgatattcgaagcgcgcgcccagcatccttggccaccgagagtcgccacgctgccgcactggccgctgatctatgcaggtgcgctggaggggcttgaccaccttgaactcgccaggacggtcgacgcggcggcccaggcagtgcagcgattcgttgcgcggattgatcgggcgacgaaaagatga

SEQ ID NO: 156 - DNA, 1392 bp, Mycobacterium Tuberculosis
atgtcctacatgattgcggtgccagacatgctcagctcggcggctggggatttggccagcatcggatcgtcgatcaatgcctcaacgagggcggccgcggccgcgacgacgaggttgttgccggccgccgccgacgaagtgtcggcccacattgcggcactgtttagcggacatggcgagggctatcaggcgatcgcccggcagatggcagcgtttcatgaccagttcacgctggccctgacgtcaagtgcgggcgcgtatgccagcgccgaggcgaccaacgtcgaacagcaggtgctgggtttgatcaacgcgcccacccaggcgctgttggggcgtccgctgatcggcaacggcgccgatgggaccgcggccaatcccaacggtggcgccggtgggttgttgtacggcaacggcggcaacgggttttcccaaaccaccgccgggctcaccgggggtaccggcgggtcggccgggttgatcggcaacggcggcaacggaggggccggcggagccggcgccaacggcggcgcgggcggcaacggcggctggctctacggcagcggcggcaatggcggcgccggcggcgccggccccgccggagccatcggcgcgccgggcgtcgcgggtggtgccggcggggccgggggaacggccggattgttcggcaacggcggtgccggcggtgccggcggagcgggcggcgccggcggccgcggtggcgacggcgggtcggccggctggctgtccggcaacggcggcgacgccggcaccggcggcggcggcggcaacgccggcaacggcggcaacggcgggtcagccggctggctgtcgggcaacggcggcaccggcggaggcggcggcaccgccggcgccggcggccaaggcggcaacggcaacagcggtattgatcccggtaacggcggccagggcgcagacaccggcaacgccggcaacggcggccacggcggatcggccgccaagctgttcggcgacggcggcgccggcggcgccggtgggatgggcagcaccggcggcaccggcggtggcggcggcttcggcggcggcaccggcggcaacggtggcaacggccacgcgggcggtgccggcggtagcggcggcaccgccggcctgctcggcagcggaggcagcggcggcaccggcggcgacggcggcaacggcggtctgggcgccggcagcggcgccaaaggcaacggcggcaacggtggcgacggcggcaagggcggcgacgcccagttgatcggtaacggcggtaacggcggcaacggtggcaaaggcggcaccggcctgatgcccggaatcaacggcactggaggcgccggcggtagtcgcgggcagatctccggcaaccccggcacgcccgggcaataa

SEQ ID NO: 157 - DNA, 267 bp, Mycobacterium Tuberculosis
gtgaaccagattctgctcagcgtgattgctgagggcgggcccggtaacaccggacccgatttcgggaaggctagcccggtggggttgctggtgatcgtgctattggtgatcgccacgttgtttctggtgcgttcgatgaaccagcaactgaagaaagttcccaagtcgttcgaccgggatcaccccgagctcgaccaggcagccgacgagggcaccgaccgcgacggaccggcccgaccaccgggacccccgcatgagtccggctaa

SEQ ID NO: 158 - DNA, 882 bp, Mycobacterium Tuberculosis
atgacggttcctcccgctggcccctacggcaactacccctacggcccgaatacgtatgggcaggacccgtattggggaggccaaccgcagggcggctcctatccgccggcctacccaccccagcagtatccgcccggctggccggcggggccctatccgccaggaccacctccgcccgggccaggatcgaagacaccgtggctgatcctcgccggcctcgcggtgctgggtgtcatcctactggtggtgatcctggtgatcggcctccgcggcgacaacaagtcgaccacggcaacctctccggcgacgagtgctcccacgtcgcaaccgttttcccagcaaaccgcaaccggttgtaccccaaatgtgtccggcggtgtgcagcccatcggcgattcgatcagtgcgggtaagctgtcgttcccgaccagcgcggcacccgggtggtcggcgttctccgacgaccagaacccgaacctcatcgacgcggtgggcgtcggccacgaggtggccggtgccgaccagtggatgatgcaagccgaggttgcgataaccaacttcgtcaccaccatggacgtcgccgcgcaagcatcgaagttgatgcaatgcgtggccgacggccccggctacgcaggctcgtcgcccaccctgggcccgaccaagacgtcgtcgatcaccgtcgacggggtcagggccgcccgggtagacgccgatatcacaatcgccgacagttcacgcaacgtcaaaggtgattcggtcacgatcatcgcggtcgacaccaagccggtcaccgtcttcctgggcgccacccccatcggtgatgcaacctcgcgcgccaccgtcgagagggtcattgaggcgctgaaggtcaacaagtcctga

SEQ ID NO: 159 - DNA, 702 bp, Mycobacterium Tuberculosis
atggttggtgattgtcccagaagccgaaccgtgcgctggagctgggatactggccatgtgaccgccgagccgcagccgacccctaggccggctaaaccgcggttgctgcaggacggccgcgacatgttctggtcgctcgcgccgctggtcgtggggtgcatcctgttggcgggcctggttgggatgtgctcgtttcaactgggcgggaccaagcggggaccgatcccgtcctacgatgcggcccaggcgctgcgggcagacgccaagacgctgggattcccgatacggttgccgcaattgccaggcggctggacgcccaactccgggggtcgcggcggcatcgagaacgggcgagcggacccggcaaccggtcaacgccgcaacgcggcgacctcaatcgtgggattcatcagcccgaccgggagatatctgagcttgacccagagcaacgccgacgaggacaagctggtcggctccatccacccgtcgatgtacccgacggggacggtcgacgtgggcggcacccgttgggtcgtttacgagggttcggacgaaaacggtgccgtcgagccggtatggacgacacggctcaccggaccgggcggggccacccagctggcaatcaccggtgccggcagcatcgatcagttccgcacgctggcgtcggcgacgcaatcgcagcccccgttgcccgcacgatag

SEQ ID NO: 160 - DNA, 198 bp, Mycobacterium Tuberculosis
atgaggacgacggtgaccgttgacgacgccttgttagccaaagcggccgaattgactggggtgaaagagaagtcgacgctcctgcgcgaggggttgcagacactggtccgggtggagagcgcccggcggttggcggctctcggcggcaccgacccgcaagctaccgcggcgccgagacgccggacgtcgccccggtga

SEQ ID NO: 161 - DNA, 606 bp, Mycobacterium Tuberculosis
atgagcgagttgacggtactgcaggccgtgcggctcaagggccgggtgatcaccaccgacctggcgcagaccttgggtgaagaccttgccgacgtcgccgcgaccgtcgacaggctgaccgcggccggcctcctggtcgacgccacgccgttgcggatcagtcccagcggccggatgaggctcgacgacttgcttgccgaggagcgcaaccgggccgattcgaccgtgctggctgccgcttaccgcgatttccgttccgtcaacgccgatttcaagaggctggtcaccgactggcagctcaagggcgaaaagcctaacacacacgacgacgccgaatacgacgccgcggtgctgtcccgcctcgatggcgtacaccggcgggtgggcccgatcatcggtacggtggccatgcagctgccgcggttgagcaggtacccggtgaaattgcgtgcggcgctggacaaggtcaaagcgggcgacatcgcctggctgacgcgcccactcatcgactcctaccacaccgtgtggttcgaactacacgaggagctgatccaggccgtcgggctgacacgagacgaagcggctaaatccggtgatgcccagtag

SEQ ID NO: 162 - DNA, 1356 bp, Mycobacterium Tuberculosis
atgtgttccactcgggaggagatcacggaggccttcgcgtcattggctaccgcgctgtcccgcgtgctggggctgacctttgacgcattgaccaccccggagcgcctggcgctgctggagcactgcgagaccgcgcgacgccagctgcccagcgtcgaacacacgttgatcaatcagatcggcgaacaatccaccgaggaggagctgggcggcaagctgggattgacgctggccgaccggttgcgcatcacccgcagcgaggccaagcggcgagtggccgaggccgccgaccttggccagcgccgtgcgctgaccggcgagccgctgccaccgctactcaccgccaccgcaaaggcacagcgccacgggttaattggtgacggccatgttgaagtaatccgtgctttcgtgcaccgcctaccatcctgggtagacctcaagaccctggagaaggccgaacgggacttggctaagcaggccacccagtaccgtcccgaccagctggccaaattggccgcgcggatcatggactgcctcaaccccgatggcgactacaccgacgaggaccgcgcccgccgccgcggcttgacgttaggaaagcaagatgtcgatgggatgtcgcggctcagcggatatgtgacccccgagctgcgcgccactatcgaggcggtgtgggccaagctggccgccccgggtatgtgcaaccccgagcagaaggcaccgtgtgtgaacggcgcgccctcgaaggagcaggcgcggcgagacacccgcagctgcccacagcggaaccacgacgcgctcaacgccgaattacgtagtttgttgacaagtggcaatctgggccagcacaacggattaccggccagcatcatcgtgaccaccacgctgaaggacttggaggccgcggccggcgcgggcctcaccggcgggggtacgatcttgcccatatcggatgtgatccggctggcccgccacgcaaaccactacctcgcgatattcgatcgaggcaaggccctggcgctctaccacaccaagcgcctggcctccccggcgcagcgaattatgttgtacgccaaggacagtggctgcagcgcacctggttgcgacgtgcccggctattactgtgaagtccatcatgtcacgccgtacgcccagtgccgcaacaccgacgtcaatgacctgacactcggctgcggtggccatcatccgttagccgaacgtggctggacgacccgcaagaacgcccacggcgacaccgagtggctaccgccgccacatctcgaccacggccaacctcgagtcaatacgttccatcacccggaaaagctcctggcagacgacgaaggcgacccgtag

SEQ ID NO: 163 - DNA, 1017 bp, Mycobacterium Tuberculosis
atgaccagctacgacaccgacctgttggtcgtcggcggcggccccggcggactcgccacggcattgcacgcacgcgcgcgtggactttcggtgatcgtggccgagcctcgcgagaatcccatcgacaaggcgtgcggcgaggggctgatgcccggtggcctggccgaattgacctcgctaggcgtggacccggtcggtctgccctttcatgggattgcctacgttggtgaacatcgtcgggtgcaggcgcggtttcgcaccgggccggggcggggcgtgcgacgcaccacgctgcatgcggcactggcggcacgagccaaagagcaagacactgaatggatccggtcgcgggtagccactattcagcaagacgcacatggtgtgaccgccgccggcgttcgcgcgaaatggttggtggcagccgatggactgcattcggccgtccggcgcgccgtcgggatcaaagccaccgccgggacaccacggcgatacggggtgcgctggcattaccggctgccggtgtggtcggacttcgtcgaagtgcattggtcccgttggggtgaggcttatgtgactccggtggaaccggatctggtcggcgtcgcgatcttgtcccgccaacgacccgaacttgcctggtttcccagccttgcacaccatctgcaagacgcgagccgcggacacgcacgtggctgcggtcccttgcgccaggtggtctcccggcgcgtcgcggggcgggtgcttttggtcggtgacgcggccgggtacgaagatgccctaaccggcgaaggcatcagccttgccgtcaagcaggccgccgcggcggtgagcgccatcgtcgacgacacaccggcgtcgtatgaggccgcgtggcaccggatcactcgtgattaccggctagtcacccgcgggttggtgctggccagtacgccacgcgcggcacgccgtgccatcgtgccgctgtgcgcacttctgcccacggcattccggtacggggtgaacatcctggcgtactga

SEQ ID NO: 164 - DNA, 714 bp, Mycobacterium Tuberculosis
atgcgagtggcggtgctcagcggcgcggggatctccgcggaaagcggtgtaccgacgttccgcgatgacaagaacggattgtgggcccgattcgacccttacgagctgtccagcacgcaaggctggctgcgcaaccccgagcgggtctggggatggtacctatggcgccattatctggtggccaacgtcgaacccaacgacgggcatcgcgcgatcgccgcctggcaggaccatgctgaggtcagcgtcatcacccagaatgtcgacgatctgcacgagcgcgccggcagcggtgcggtgcatcacctgcacggcagccttttcgaatttcgttgtgcacgttgtggtgtgccctacaccgacgcccttccggagatgcccgagcctgcgatcgaagtggagccgccggtctgcgactgcggcggtctgatccggcccgacatcgtatggttcggtgagccgctgccagaggagccgtggcggagcgcggtcgaggcgacagggagcgccgacgtgatggtcgtggtggggacctcggcgatcgtctacccggcggccggtttacccgacctggcgctggcgcgcggcactgccgtgatcgaagtcaatcccgagcccacgccgttgtccggcagcgcgacgatcagcatccgcgagtcggccagccaagcgttgccggggctgttggagcgcctgcccgccctgctgaaatag

SEQ ID NO: 165 - DNA, 1296 bp, Mycobacterium Tuberculosis
atgtgccgcaccctgatcgacggcccggtgcgctcggcgatcgctaaagtcaggcagatagacaccacctcatccaccccggcggccgccaggcgcgtgacctcaccaccggcccgggagacacgcgccgccgtgctgctactggtcctcagcgtcggtgcgcgactcgcctggacctatctggcgcccaacggcgcaaacttcgtcgacctgcacgtttacgtgagcggtgcagcgtccctcgaccatcccggcaccctgtatggctacgtctacgctgatcagaccccggacttcccgctgccgttcacctatccgccgtttgcggctgtggtcttctacccgttgcatttggtgccgttcggtctgatcgcgctgctgtggcaagtagtgacgatggccgcgctctacggcgcggttcggatcagccagcgcctgatggggggcaccgctgagaccggtcatttcgccgcgatgttatggacggcgatcgccatctggatcgagccgttgcgcagcacctttgactatgggcagatcaacgtgctgctgatgctggcggcgctttgggcggtctacaccccgcggtggtggctatcgggactgctggtcggggtggcctcgggtgtcaagttgacgccggcgattaccgctgtctacctcgtcggcgttcggcggttgcatgcggccgcattttcggtggtcgtgttccttgccaccgtcggcgtgtcgctactggtcgtcggcgatgaagcccgctactacttcaccgacctgttgggcgacgcaggccgggttgggcccatcgccacctccttcaatcaatcctggcgcggcgcgatttcccggattctcggtcacgacgccggttttggtccgctggttctggctgcgatcgccagtacggcggtattggccatcctggcctggcgtgcgctcgacaggtccgatcggctgggcaaactattggtggtcgagttgttcggcctgctgctctcgccgatctcctggactcaccactgggtgtggctagtgccgctgatgatctggctgattgacgggccagcgcgtgagcgcccgggcgcccggattttgggctggggctggttggtgttgaccatcgtcggcgtgccgtggttgctgagctttgctcaaccgagcatctggcaaatcggccggccgtggtatttggcctgggccggtctggtctacgtggtggcgacgctggcgaccttgggctggatcgccgcctccgagcgttacgtgcgcattcggccgcggcgcatggccaattag

SEQ ID NO: 166 - DNA, 1677 bp, Mycobacterium Tuberculosis
atgaaggtcatggcgcagatggcgatggtgatgaacctcgacaaatgcattggttgccatacctgctcggtgacctgcaagcaggcctggaccaatcgctcgggaaccgagtacgtgtggttcaacaatgtcgaaacccgtccgggtgtgggctacccgcgcacctacgaggatcaggagcggtggcgcggggggtgggtgcgcgacaagaagggccggctgcggctgcgcgacggcggccggatccataagctgttgcgcatctttgccaaccccaagctgcccactatcggcgactactacgagccgtggacctatgactacgaaaacctgacatcggcgccggcgggtgacacctttccgaccgcggcgccgcgaagcctgatcagcggcaatccgatgaaggtgtcgtggggatccaactgggacgacaacctggccgggtcgccagagatcgtgccgaacgacccggtgctaaagaaggtcaaccaagtcaaccaagaggtcaagctgaagcttgaagagaccttcatgttttacctgccgcggatctgcgagcactgcctgaacccgtcgtgtgtggcgtcgtgtccgtcgggggcgatgtacaagcgcaccgaggacggcatcgtgctcgtcgaccaggaccgctgccgcggctggcggatgtgtgtgtccgggtgcccatacaagaaggtgtatttcaaccacaagaccggcaaggccgaaaagtgcaccctgtgctatccgcgcatcgaggtggggttgccgacggtgtgctcggaaacgtgtgtggggcggctgcgctatctgggtctggtgctctatgacgtcgatcaggtgctgcaggccgcgtcggtggaaagcgacaccgacctctacgaggcgcagcgccggatcctgctggacccgcacgatccgcgggtgatcgccggggcgcgcgcggaaggcatcgccgacgagtggatcgaggccgcccagcggtccccggtgtacgcgttgatcaacacctaccgggtggcgctgccgctacatccagagtaccggaccatgccgatggtctggtacatcccgccgctgtcgccggtggtcgacgcggtcagccgcgacgggcacgacggggaggacctgggcaatttgttcggcgcgctggacgcactgcggattccgattgcctatctggccgagctgttcaccgcgggcgacaccgaggtggtcgcgggcgtgttgcggcggctggcggcgatgcgctgctacatgcgcgacatcaacctgggccgggagacccagccccacatcccggaatcggtcgggatgaccgaggagcagatctaccagatgtaccgactgttggctgtggcgaaatatgaagagcgctatgtcattccgacgtcgtacgcgggggagctgccggccgcggcgatgaccgacgatatggggtgctcgttgtcggtcgacggcggaccgggaatgtacgagtccggtccgttcgggcagggcagccctactccggtgccaatcgccgtggagagcttccacgctctgcagcatgccggtagcgcggccaccggcggcgctggccgatcccgggtcaacctgctcaactgggaccccaacggcgcagcggcggggctcttcccggagcctcagcccagcaaggatgtggtccagcgatga

SEQ ID NO: 167 - DNA, 2571 bp, Mycobacterium Tuberculosis
gtgccgcagcctgtaggtcggaagtccaccgctctgccgagtcccgttgtaccgccccaggcaaatgcctcagcgttgcggcgggtactgcgacgggcccgagatggtgtcacgctgaacgtggatgaggcggccatagcgatgaccgcacgcggtgacgagctggccgacctgtgcgcgagcgccgcgcgggtgcgcgatgcgggtctcgtgtcggccggccggcacgggcccagcggcaggttggcgatcagctattcgcgcaaggtgtttatcccggtcacccggttatgccgggacaattgccactattgcacgttcgtcaccgtgccgggcaagctacgcgcccaaggttccagcacgtatatggaacccgacgagatcctcgacgttgcccgccgaggtgccgaattcggttgcaaggaagcgctattcactctcggtgaccgtccggaggcgcgttggcgccaggcacgcgaatggctcggcgaacggggctatgactccacgttgtcctacgtgcgcgcgatggcaatccgtgtgctggagcaaaccgggctgttgccgcacctgaacccgggtgtgatgagctggtcggagatgtcgcggctcaaaccggtggcgccgtcgatgggcatgatgctggagacgacctcgcgacggctgttcgaaaccaaggggctcgcccactacggcagccctgacaaagacccggcggtgcggctgcgtgtcctgaccgacgccggccggttgtccattccgtttaccaccggtctgttggtcggcatcggcgagacgctatccgagcgcgccgatacgttacatgcgattcgcaagtcgcacaaggagttcgggcatatccaagaagtgatcgtgcagaacttccgcgccaaggaacacaccgcgatggccgccttccccgatgccggaatcgaggattacctggcgacggttgcggtggcgcggctggtgctgggcccgggcatgcgcatccaggcgccgccgaacctggtgtctggcgacgaatgccgggcgctggttggcgccggggtcgacgactggggcggtgtctcaccgttgacgcccgaccatgtcaaccccgaacggccctggcccgctttggacgagctggcggcggtcaccgccgaagccggctacgacatggtgcagcggctgaccgcgcaacccaaatacgtacaggcgggcgcggcgtggatcgacccgcgggtgcggggacatgtggtggcgctggcggatccggcgaccggcctggcccgcgacgtcaacccggtgggcatgccgtggcaggagcccgacgacgtggcgtcctggggccgggtcgatctgggcgcagcgatcgacactcagggccgcaataccgcagtgcgcagcgacctggccagcgccttcggtgactgggaatcgatccgcgagcaggtgcacgagctggcggtccgcgctccggaacgcattgacaccgatgtgcttgccgccctgcgatcggcggagcgtgcgcccgccggctgcaccgacggcgagtatctggcgcttgccaccgccgacggtcctgcgctggaagccgttgccgcactggctgattcgttgcgccgcgatgtcgtcggcgacgaggtgacctttgtggtcaaccgtaacatcaacttcaccaacatctgctacaccggttgccggttctgcgcgttcgcccagcgaaagggtgacgccgacgcctactcgctgtcggtcggagaggtcgccgaccgggcatgggaggcccacgtcgccggggccaccgaagtatgcatgcagggcggtatcgatcccgagctaccggtcaccggctacgccgatctggttcgtgccgtcaaggcgcgggtgccctccatgcatgtgcacgcgttttccccgatggagatcgccaacggcgtcaccaagagcgggctgagcattcgcgagtggctgatcggcctgcgcgaggccgggctggataccatcccgggtaccgccgcggaaatcctggacgacgaggttcgctgggtgctgaccaagggcaagctgccgacgtcattgtggatcgaaatcgtgacgaccgcccacgaggtgggtctgcggtcatcatcgacgatgatgtacgggcatgtggacagtccacggcactgggtcgcccatcttaacgtgctgcgcgatattcaggaccgtaccggcggcttcaccgagttcgtcccgttgccgttcgtgcaccagaattcaccgttgtacctggccggtgcggcgcgccccgggcccagccatcgcgacaaccgcgcggtacatgctttggcgcggatcatgttgcacggccgcatctcgcacattcagaccagctgggtgaaacttggagtgcggcgcacccaggtgatgctcgaaggtggcgccaacgacctgggcggcacgctgatggaggagaccatctcgcggatggccggttccgaacacggatcggccaagaccgtcgctgagctggtcgcgatcgccgaaggcatcggccgcccggcgcgccagcgcactaccacatacgccctgcttgcggcctag

SEQ ID NO: 168 - DNA, 333 bp, Mycobacterium Tuberculosis
atgaggctgtcgttgaccgcattgagcgccggtgtaggcgccgtggcaatgtcgttgaccgtcggggccggggtcgcctccgcagatcccgtggacgcggtcattaacaccacctgcaattacgggcaggtagtagctgcgctcaacgcgacggatccgggggctgccgcacagttcaacgcctcaccggtggcgcagtcctatttgcgcaatttcctcgccgcaccgccacctcagcgcgctgccatggccgcgcaattgcaagctgtgccgggggcggcacagtacatcggccttgtcgagtcggttgccggctcctgcaacaactattaa

SEQ ID NO: 169 - DNA, 2025 bp, Mycobacterium Tuberculosis
atgacaaatccatacccaaatctgctgtccccgttggaccttgggtttaccacgctgcgcaaccgggtggttatgggttcgatgcacaccggactggaagaccgggcccgccatatcgatcggctcgccgactacttcgccgaacgtgcacgcggcggcgtcgggctgatcatcaccggtggctacgcgcccaaccgcaccggatggctgctgccgttcgcctccgaactcgtcacttcggcgcaagcccgacggcaccgccgaatcaccagggcggtccacgattcgggtgcaaagatcctgctgcaaatcctgcacgccggacgctacgcctaccacccacttgcggtcagcgcctcgccgatcaaggcgccgatcaccccgtttcgtccgcgagcactatcggctcgcggggtcgaagcgaccatcgcggatttcgcccgctgcgcgcagttggcccgcgatgccggctacgacggcgtcgaaatcatgggcagcgaagggtatctgctcaatcagttcctggcgccgcgcaccaacaagcgcaccgactcgtggggcggcacaccggccaaccgtcgccggttcccggtcgagatcatccgacgcagccgcgccgccgtcggatgcgacttcatcatctgttaccggctgtcaatggccgactacgttgcagaaggccagagttgggatgaaatcgtcgcgctggcaaccgaagtggaaggggcaggcgcaaccatcatcaactccggcttcggctggcacgaggcccgggtgcccactatcgtcacctcagtgccgggcggcgcgtttgtcgacatcagcagcgccgtcgccgaacacgtcactatcccggtggtggcgtccaaccggatcaacatgccgcaggccgcggaacggattctggccgaaacccaggtgcggctgatatcaatggcccggccgatgctgagcgacccggactgggtgctcaaggcgcagtccaatcgggtcgacgaaatcaacacctgcatctcctgcaatcaagcctgcctggaccacgcatttgccaggaaaacggtgtcgtgtctgctcaatccacgcgccgggcgcgagacgcagttggtgctgtccccgacccggcgcgcccgctcggtggccgtcgtcggggctggaccagccgggctggccacggcggccaacgccgcgcaacggggtcaccgggtcacgctgttcgaggccaacgactttatcggtggacagtttgacatggcccgccgcattcccggcaaagaggaattcagcgaaaccatccggtatttctcgacgattctggccaaacacggtgtcgaggtgcgactgggcactcgggtggccgcccaggagttgaccggctacgacgaggtcgtcttggccaccggcgtggcaccgcgcattccggccatccccggcatcgaccaccccatggtgttaacctacgccgaagccatcaccggtgtcagaccggtcgggcgaaccgtggctgtcgtcggcgccggcggcattggcttcgacgtcaccgaactgctggtcaccgactcctcacccaccctcaacctcaaagagtggaaggccgaatggggggtcgctgatccgcgagaagcccgcggagcgttgacgactccactgccggcgccgcccgcccgtgaggtgtacctactgcagcgcaccaaaggcccgcagggcaagcggctcggcaagaccaccggatgggtccaccgggcgtcgttgaaggccaagggcgttcatcagctgtctggggtgaactacgaacagatcaacgacgacggcctacacatcagcttcggcccgaagcgcaggcggccccagctgctggcggtggacaacgtagtggtctgcgccggccaggaaccggtgcgagatctggagagtgaactgcgccggcacggcattaacccgcacatcatcggtggcgcggcggttgccgctgagttggacgccaagcgcgccatcaagcaaggcaccgaacttgcggccaggctataa

SEQ ID NO: 170 - DNA, 1467 bp, Mycobacterium Tuberculosis
gtgcgcaccgcaaccgccacatcggtcgccgttatcggcatggcttgccggctcccgggcggcatcgattccccacaacgcctctgggaagcgctgttacgcggcgacgatttggtgggtgagattcccgctgaccggtgggacgcgaacgtgtactacgaccccgaacctggtgtccctggtcgatcggtatcgcgttggggcgcctttctggacgacgtcggcgggtttgactgcgatttcttcggcctgaccgagcgggaggcgaccgcgatcgacccacagcaccgcttgctgctggaagtgtcgtgggaggctatcgagcacgcgggtgtggacccggcgacgctcgctgaatcacaaacaggtgtcttcgtaggactgacacacggcgactacgagctgctgtccgcggattgcggcgccgcggaaggaccgtacggattcaccggcaccagtaacagtttcgcgtccgggcgagtggcctacacactcggactgcatggccccgcggtcacggtggacaccgcgtgctcgtccgggttgacggctgtgcatcaagcctgccgcagcctggatgacggtgaaagcgatctcgctcttgccggtggtgtggttgtcacgctagaaccgcggaagtccgtctcgggttccctgcaaggcatgttgtcgcctaccgggcgttgccatgccttcgacgaagcagctgatggcttcgtgtccggtgaggggtgcgtggtcctgctgctgaagcggctaccggatgcggtgcgcgacggtgatcgtgtgctggcgatcgttcgtggcaccgcagccaaccaggatggccgcaccgtgaatatcgcggcgccgtcggcgcaggctcagatcgcggtgtatcagcaagcgttggctgcagcgggcgtcgaagcgtcgacggtggggatggtcgaagcccacggcaccggcacccccgttggagatccggtcgaatacgcgagcctggccgcggtgtacggaaccgagggtccgtgcgcgctgacgtcggtgaaaacaaacttcggtcacctgcagtcggcatcggggcccctggggttgatgaagacaatcctggcgttgcggcatggggttgtgccgcagaacctgcacttctgccggctgcctgatcagctggctgagattgacactgaactctttgtgccgcaagcgaatacatcctggccggacaacaccggacagccacgtcgcgctgcggtttcctcgtatggaatgtcgggtaccaacgtgcatgccatcttggagcaagcgccggtatcagaaccagcggcttcgggacctgagctcactcccgaagccggtgggctggcgttgtttccggtgtcggctacctcggctgagcaactacacgtcacggccgcccggctggcggattgggtcgaccagaacggcaacgcgggcagtcgagttagcatgcgggacctgggctaa

SEQ ID NO: 171 - DNA, 4749 bp, Mycobacterium Tuberculosis
gtgacggcgagcagttttgacgagctgagcgcggcgctgcgggacgtcgctggcgatcagattccctatcagcccgcagtggggcacgacgaccgcgggccggtgtgggtgttctccgggcaaggctctcagtggcccgggatgggcactgaactgctggtagccgaaccggtgttcgccgccaccgtcgcggcgatggagccggtgatcgctagggagtcagggttttcggtgaccgaagcgatgtcggcgccacagacggtcagcggtattgaccgggtgcagcccaccatcttcgcggtgcaggtcgccctggccgcggccctgaagtcgtatggggtacgtcctggtgccatcatcgggcactcgctcggcgaggctgcggcagccgtggtcgccggagcactgtcgctgcacgacggattgcgagtcatctgccggcgctcgcggctgatgtcgcgcatcgccggtagtggcgcgatggcatcggtggaactgcccggccaacaagtgttgtcagaacttgcgattcgtgggatctccgacgtcgtgctctcggtggttgcctctccgacctcaaccgtcgtcggcggcgccacgcagtcgatacgtgacctggtggcggcctgggagcagcaggatgtgctggcgcgcgaggtagctgtggacgtcgcttcacatacaccgcaggtcgatcccatcctggacgagttgctcgaggtcctggccgaggtcgatccgacggcgccggaaattccgtattactccgcaacgttgtgggatccgcgcgagcgaccgtcgttcaccggcgagtactgggtggaaaacctgcggtacacggtgcgattcgcggcggcggtacaggccgcgctcaaggacgggtaccgagtgttcggcgagctggctccgcatccgctgctcacctacgcggtcgagcagaacgccgccagtctcgacatgccgatcgcaacgcttgccgcgatgcggcgcggggaacagctgccgttcgggttgcgcggcttcgtcgccgacgtgcacaacgccggcgccaaggtggacttctctgtccagtaccctgatgggcgcttggtggatgcgccattgccgagctggacgcaccgcaccctgatgctcagccgtgaggattcacaccgctcgcacaccggcgcggtccaggcggttcatccgctgcttggggcccatgtgcacctgttggaggaaccggagcgtcacgtctggcaggccggggttggcaccggggcgcatccgtggctcggtgaccatcggatacacaacgtggctgcgtttcccggtgcggcctactgtgagatggcattggccgcggcgcgcaccactcttggcgagctgtcggaggtgcgcgacatcaagttcgagcagacgctgttgctggacgagcagacggtggtctcatcggccgcgacgatcgccgcgcctgggatcctacagttcgcagtcgagagtcatcaggaaggcgagcccgcacggcgggccagcgcgatgctgcacgcattggaggagatgccgcagccgcccgggtacgacacgaacgctctgaccgccgcccatgagtccagcatgagcggtgaggaactgcgaaaaatgtttaacagcttaggtattcagtatggtccggctttttcaggcctagttgcggtgcacacggcgcgcggggacgtcaccacagtgctcgccgaggtcgcgctgcctggagccatccgatctcagcagtcggcatatgccagccacccggccctgcttgatgcgtgtttccagtcggtgcttgttcatcccgaggtccagaaggcgactgtcggtggtctgatgctgcccgtgggcgtgcgtaggctgcgcaactatcactcgacgcgcagcgcgcactactgcctcgcccgggtcacgtcatcgtcgcgagccggcgaatgcgaagccgatctcgacgtgttcgaccaggccggaacggtacttttgaccgtcgagggattacggctggccgcagggatttccgaacatgaacgcgcgaaccgggtgttcgacgagcgattgttgaccatcgagtgggagcggggtgagctgcctgaggtgccgcagatcgatgcgggatcctggctgctgctcagtgcgtccgaagctgatccgctgaccgcgcaactcgccgacgcgttgaatgccgttggtgcccagagcactagcgtggcttcggcgtcggatgtcgcacaattgcgttcgctgctcggaggcaggctcaccggtgttgtcgtggtgactggcccgccaacgggtggtttgacacagtgcggccgcgactatgtgtcacagctggtgggtattgcccgcgagctcgcggagctgcccggtgagccgccgcggctgttcgtggtgaccaggagcgcggcgagcgtgctgccgagcgatcttgccaacttggaacaggcgggattgcgtggactgatgcgggtgatcgattccgagcatccgcacctgggtgccaccgcaatcgacgtcgacaacgacgagaccgtcgctgccctggtggccagccaactacagagcgggtcgcaggaggacgaaaccgcttggcgcaatggcatttggtacaccgcccggctgcgtcccggtccgttacgcccggccgaacggcgaaccgccgtcgtcgaatacagacgcgacggtatgcgcctgcagatccgcactcccggcgacctcgagtcgttggagttcgtcacattcgaccgggtcgcgccgggaccgggcgagatcgaggtcgcggtgaccgcatcgagtgtcaacttcgccgacgttctggtcgctttcgggcggtatcccaccttcgagggctaccgacagcagttgggcatcgacttcgccggtgtggtgaccgcggtcgggccggatgtcaccgagcatcggatcggtgatcacgtcggcggcatgtccgccaatggctgctggagcacattcgtcagatgcgatgcccggctggcggtgacgctcccgcccgagctgccggtggccgccgccgccgcggtaccgaccgcctccgcgacggcttggtacgccctgcacgatctggctcgcatctgctcggacgacaaggtgctgattcactcggggaccggtggtgtcgggcaggcggcgatcgcgatcgcacgggccgccggatgcgagatcttcgccaccgcgggcagtgcccagcggcgacaactgctgcacgacatgggtgtcgagcatgtctacgactcacggagcaccgagttcgccgagcagatccgaggcgacaccgatgggtatggtgtcgacgtcgtactcaactcgctgcccggcgccgcacaacgtgctgggatcgaattgctggcctttggcgggcgattcgtggagatcggcaaacgtgacatctacggcgacactcggctcgggttgttcccgttccgccgcaacctgtcgctgtatgccgtcgacttggcgctgctgacacacagccacccgcacaccgtccggcgcctgctgaaaaccgtctaccaacacacggtcgagggcacgctgccggtgccgcagaccacgcactatcccattcacgacgctgccgttgccattcgtttggtcggcggagccgggcacaccggaaaagtggtgctcgatgtgccgcgtaccggtgaaggcgtggccgtggtgccccccgaacaggtccgcacgtcccggcccgacggcgcctatctcgtcaccggtggtttgggcggcctcggcctgttccttgccggcgagctggcggcggcgggctgcggacgcatcgtgctcaactcccgttcgacgcccagcccgcacgccaccagggtcatcgagcggctccgcgccgccggtgctgatatccaggtggaatgcggtgacatcgctgatgccgcaacggcccaccgagtggtggcggtggccaccgcctcgggcttgccggtgcgcggcgtgctgcacgcggcggcggtggtcgaggacgctacgttggccaatgtcaccgacgaacttatcgaccgctgttgggcgccgaaggtacacggcgcgtggaacattcatcgggccaccgccgcgcagccactggagtggttctgcttgttctcctcggccgcggccttggtgggctcgccgggtcaaggcgcatatgcggcggccaacagctggttggacgcttttgcccactggcggcgggcgcagggccttccggctacctcaatcgcctggggagcatgggccgagattggccgcgctaccgcgctggccgaaggcaccggcgcagcgatcgcgcccgccgagggtgctcgagccttccagacgctgcttcgctacggccgggcgtactccggctatgccccgatcatgggtaccccatggttgacggcctttgcgcaacgtagccgatttgccgaagcgttccacgccacgggccaaaatcaaccggccaccgggaaattcctcgccgaactgggcagcttgccccgcgaagagtggccccgcacagtcaggcggttggtatcggaccagatcagcctgctgctgcggcgaaccattgatccggaccggccgctgtccgactatggtttggattccttgggcaacttggagttgcggacccgcatcgaaaccgaaacgggtatacgcgtcagtcccacaaagatcaccacggttcgcggcttggccgagcacgtgtgcgacgagctggcagccgcccaatctgcgccggtctga

SEQ ID NO: 172 - DNA, 1617 bp, Mycobacterium Tuberculosis
atgcggatcgccggcgtggggctcggccagttgctcctggcgctggatgcgaccgtggtcagcctggtggacgccccgcgcggcctggacctgccggtggcgtcgacggcgctgatcgattccgacgacgtgcggctgggcctggcggccgcggcgggctcggccgatgtgttcttcctgatcggggtcaccgacgacgaggcggtgcgctgggtcgacgatcaggcacgccaacgggcgccggtggcgatcttcgtcaagcacccgtcggactcggtggtggccggggccgtccgcgccggctcggcggtggtagccgtggagccgcgggcccgctgggaacggctgtaccacttggtgaatcatgtcttggagcatcatggtgaccgggccgaccccaccgacgattccggaaccgacctgttcgggttggcacagtccctggccgaccgcatccacggcatgatcagcatcgaggacgcccagtcgcacgtgctcgcctactcggcctccaacgacgaggccgacgagctgcgtcggctgtccatcctgggccgcgccggcccgcccgagcatctgcagtggataggtcaatggggcatcttcgatgccctgcggcccggccgtgaggtggtgcgggtggccgagcgccccgagctggggttgcgtcctcggctagccatcgggattcatcagccgggggtcggtgcgctgcggccaccggtgttcgccggcacgatctgggtccagcaaggctcgcagccgttggccgacgatgccgaggagatgttgcggggtgctgcggtgctggccgcccggatcatgtcgcgactggcgacccagcccaatacgcacgcgctgcgggtacagcaactactgggcctggccgagctgaacgcaaccacagcacccgtcgacgtatcgaccatcgcccgtgaactcggcgtcgccgccgagggcaacgcaacgctgatcggtttcgacaccgcggaaaaccgcgataccgcagtccgccatgttcggcttgttgacgtcatggcattgagcgccagcgcttttcgccacgacgctcaggttgccgccaacggctcacggatctatgtgctgctgccccaaaccacgaccggccgagctgtcacctcgtgggtccgcggcacaatcagcgcactgcgcgccgagctgggagtagcactacgggcagccatcgcggggccggtcgcgggacttgccgaagtcaacccggcacgcgtcgaggtggatcgggtactcgagagtgccgagcgccacccgatcttggggcaggtgacatcgctggccgaggcacgcaccaccgttctgctcgacgaaatcgtcaccctggtcggcaccgaccagcggctcgtcgatcctcggatacgtgacctgggcgcccaggacccggtgctggctcagaccctgcgtgcctacctggatgccttcggcgacatcggcgccgccgcacggtcactgcaagtgcatcccaacaccgttcgctaccggataaggcggatcgagcagctgttgtcgacctcgctgggcgatccggatgtgcggctgctcttttcgctggggctgcgggccatggaacgcacggcttag

SEQ ID NO: 173 - DNA, 1422 bp, Mycobacterium Tuberculosis
gtgctgctggcctccctgaatcctgctgtcgtctccgccgccgatatcgcggacgcggtccgcatcgacggcgacgtgctgagccgtagcgacctggtcggcgcggcaacgtcggtggccgagcgggtcgccggtgcgcaccgggtcgccgtgctggccacgccgaccgcgtcgacggtgctggcgatcaccggctgcctgatcgccggcgtgccggttgtgccggtacccgccgatgtgggcgtcaccgaacgccggcacatgctcaccgactccggcgtccaggcatggctgggcccgttgcccgacgacccagcggggctgccacacatcccggtgcgcacgcacgcgcggtcctggcaccgttatccggagccctcacccggggccatcgccatggtggtctacacgtccggcaccaccgggccgcccaaaggcgtgcagctgagccggcgggcgatcgccgccgacctcgatgcattggcagaggcctggcagtggacggccgaggacgtgctggtccacggtctgccgctgtatcacgttcacggcctggtgctgggcttgctcgggtcgctgcggttcggaaatcgcttcgtgcacaccggtaaaccaacgccggccggctacgcccaggcctgttatgaagcgcacggcacgttgttttttggggtgccgacggtgtggtcacgagtggcggccgaccaagctgccgccggggcgctcaaaccggcgcggctgctggtgtccgggagtgcggcactacccgtgccggtgttcgacaagctggtgcagctcaccgggcaccggcccgtcgaacgctacggtgcttcggagtcgctgatcaccctatcgacgcgggctgacggtgagcgtcgcccgggctgggtcggcctgccgctggccggtgtgcagacccgactggtggacgacgatggcggtgaggtcccgcacgacggggaaaccgttggaaagcttcaggttcgcggtccgaccctgttcgacggctacctgaatcaacccgatgccaccgccgcggcgttcgacgccgacagctggtaccgcaccggcgacgtcgcggtggtcgacggcagtgggatgcaccgcatcgtgggacgcgagtcggtcgacttgatcaagtcgggtggataccgggtcggcgccggtgaaattgaaacggtgctgctcgggcatccggacgtggcggaggcggcagtcgtcggggtgcccgacgatgatctaggccagcggatcgttgcctacgtagtcggctcagcgaatgtcgatgcggacgggcttatcaactttgttgcccaacaactttcggtgcacaagcgcccgcgcgaggtgcgtatcgtagatgcgctgccgcgcaacgcgttggggaaagtgctcaagaagcagttgctgtcagaaggctga

SEQ ID NO: 174 - DNA, 1176 bp, Mycobacterium Tuberculosis
atggtggatttcggggcgttaccaccggagatcaactccgcgaggatgtacgccggcccgggttcggcctcgctggtggccgcggctcagatgtgggacagcgtggcgagtgacctgttttcggccgcgtcggcgtttcagtcggtggtctggggtctgacggtggggtcgtggataggttcgtcggcgggtctgatggtggcggcggcctcgccgtatgtggcgtggatgagcgtcaccgcggggcaggccgagctgaccgccgcccaggtccgggttgctgcggcggcctacgagacggcgtatgggctgacggtgcccccgccggtgatcgccgagaaccgtgctgaactgatgattctgatagcgaccaacctcttggggcaaaacaccccggcgatcgcggtcaacgaggccgaatacggcgagatgtgggcccaagacgccgccgcgatgtttggctacgccgcggcgacggcgacggcgacggcgacgttgctgccgttcgaggaggcgccggagatgaccagcgcgggtgggctcctcgagcaggccgccgcggtcgaggaggcctccgacaccgccgcggcgaaccagttgatgaacaatgtgccccaggcgctgcaacagctggcccagcccacgcagggcaccacgccttcttccaagctgggtggcctgtggaagacggtctcgccgcatcggtcgccgatcagcaacatggtgtcgatggccaacaaccacatgtcgatgaccaactcgggtgtgtcgatgaccaacaccttgagctcgatgttgaagggctttgctccggcggcggccgcccaggccgtgcaaaccgcggcgcaaaacggggtccgggcgatgagctcgctgggcagctcgctgggttcttcgggtctgggcggtggggtggccgccaacttgggtcgggcggcctcggtcggttcgttgtcggtgccgcaggcctgggccgcggccaaccaggcagtcaccccggcggcgcgggcgctgccgctgaccagcctgaccagcgccgcggaaagagggcccgggcagatgctgggcgggctgccggtggggcagatgggcgccagggccggtggtgggctcagtggtgtgctgcgtgttccgccgcgaccctatgtgatgccgcattctccggcggccggctag

SEQ ID NO: 175 - DNA, 369 bp, Mycobacterium Tuberculosis
gtggcgttggtgttggtgtacctggtggtgctggtcctggtggcgatcgtgctgttcgctgcggcgagcttgctattcggccgtggcgagcagttgccgcccctgccgcgggcgacgacggcgacgacgctgccggcgttcggggtcacccgcgccgacgtcgacgcggtcaagttcacgcaggtgctgcgcgggtacaagaccagcgaggtggactgggtgctggaacggctcggccgtgagctcgaggcgctacgctctcagctcggggcgatccacgcctcgtcggaagacgccgaggccgagtctgacgcgtcaaacccttcgcgcggcgagaccgtcgtgcactaccgttctgaccccgcgtga

SEQ ID NO: 176 - DNA, 396 bp, Mycobacterium Tuberculosis
gtgttcgccaacatcggttggtgggaaatgctcgtcctcgtcatggtcgggctggtggtgcttggcccggagcggctcccgggtgccatccgctgggcggcaagcgctctgcggcaggcgcgcgactatctcagcggtgtgaccagccagctacgtgaggacattggacccgaattcgatgatctgcggggacatctcggtgagctgcagaagctacggggaatgactccgcgggctgcgttgaccaagcacctactggatggcgatgattccctgttcaccggagacttcgaccgaccgacgccgaagaaaccggatgcggcgggctcggcggggccggacgctactgagcagatcggtgcggggcccatcccgtttgacagcgatgccacctag

SEQ ID NO: 177 - DNA, 558 bp, Mycobacterium Tuberculosis
atgagtcgacagtggcactggctggcagcgacgctgctcctgatcaccaccgccgcgtgcagtcgtccgggcaccgaggaaccggattgcccgacgaaaataaccttgccgcccggtgctacgcccaccacgaccctcgacccgagatgcatagtgcgcgcgaccaccaccggcacagccgacggcgatgcggcgtcgcgctggaccggaaccgtgcggatcgccgggttctatgcctcgatctgcaacgcggtatgggacgggaacgtcagccttgcgggaaaggacgagctgaccggcaaggctacgcttatcctcgtcgaaaccagttgcccgggcaaggttgtcgccggcgaactcgtgctgaaggggaacgtcggttcggacagcctcgcgatcacctgggcgcaccccgaactcccgcagcgggcgttcgacctcggcgccggacagggcacgatccgccgatcgggcgaccgtgccgagggaacgttcaactcggatatgggtgggggcaccgagttcttcttgacgtggtcgctgacgatgcgtaactga

SEQ ID NO: 178 - DNA, 1308 bp, Mycobacterium Tuberculosis
atgggatcggtcaacagggtgtacctggcgcggctctcgcggatgtcggtgctgggaccgctcggcgaatccttcgggcgcgttcgcgatgtcgtgatcagcatcagcattgtccgccaacaaccgcgagtgctcgggctggtggtcgatttggcgacccgccgcaagatattcataccgattctgcgggtcgccgcgatcgagccgcacgcggtgacactgagcaccggcaacgtgtcactgcaccgcttcgagcagcggccaggcgaggctctggcgctgggtcaagtgctcgacaccctggtgaaggtcaacgatcccgcactacccgagctggccggcgtcgacgtcgtggtcaccgacctgggtgtcgagcaaacccgaagtcgcgactggatggtgactagggtcgccgtccgcacccaacgtcggctccgacggcgctgcccagtgcacgtcgtggactggcacaacgtggcggggttgacgccgtcggccttggcgatgccgggtcaagacgtggcacagctgctcgaccagttcgagggatggaaagcggtcgacgtggccgacgccatccgcgggctgccgccgaagcgccgccacgaggtgttcaaggcgctccacgacaagcgcttggccgacgtcctgcaggagctgcccgaactggatcaggccgaggtgttgtcgcaactgggcaccgaacgcgcggccgacgtgctggaggagatggatcccgacgacgccgccgatctgctcgcggtcctgaatccgaccgaagccgagttgctgctgacacgaatggatcccggcgactccgggcaggtgcgaaggctgctgacgcactcccccgacacggcgggcggattgatgacttccgatccggtggtgttgaccccggacacctcgattgcggaggcgttggcgcgggtccgcgatcccgatctcacccccgccctggcgtcaatggtgttcgtcgcgcgcccgcccacggccacgcccactgggcactacctgggttgtgtgcatttgcagcggctgcttcgtgacccgccggccgagctggtcggcggagttgtggacactgacctgctcacgctcactccggagaccccgctggccgcggtgactcgctacttcgccgcctacaacctggtgtgcggaccggtggttgacgacgagaaccacctgctgggagcggtgaccgtggacgacctgctcgaccatctattgccgcatgactggcgtgtagatatgccggagctcgacccctccggagcaccggacagacccggaggaccacggtga

SEQ ID NO: 179 - DNA, 1101 bp, Mycobacterium Tuberculosis
gtgttcccagggtttgacgcattgcccgaagtgctgcgaccggtcgcgcgaccccagccgccgaacgcacaccccgttgcccagccaccggcccaagccttggtcgactgcggtgtctacgtctgcggccagcgactgcccggcaagtacacctacgccgccgcgctgcgcgaggtgcgcgagatcgaactgaccgggcaggaggcgttcgtctggatcgggctgcacgagcccgatgaaaaccagatgcaggacgtagcagacgttttcgggttgcacccgttagccgttgaggacgccgtgcacgcgcaccagcgacccaagttggagcgctacgacgagacgctgttcctcgtcctcaagaccgtcaactacgtcccgcacgaatcggtggtactggcccgcgagatcgtcaaaaccggcgagatcatgatcttcgtcggcaaggatttcgtggtcaccgtccgccacggcgaacacggcgggttatccgaggtgcgtaagcggatggatgccgaccccgaacatttgcggttgggaccgtatgcggtgatgcacgcgatcgccgactacgtggtcgaccactacctcgaggtgaccaatctcatggagaccgatatcgacagcatcgaggaagtagcgttcgcgccgggccgcaagctcgacatcgaaccgatctatctgctcaagcgggaagtggtcgagttgcgccggtgcgtgaatccgctatcgaccgcattccagcgcatgcagaccgagagcaaagacctcatttcgaaagaagtgcggcgctacctgcgcgacgtcgccgaccaccagaccgaggccgccgaccagatcgccagctacgacgacatgctcaactcgctggtgcaggccgcgctcgcccgggtcggcatgcagcaaaacatggacatgcgcaagatatccgcgtgggcaggtatcatcgcggtccccaccatgatcgcgggcatctatggcatgaactttcacttcatgcccgagctggactccaggtggggttacccgacagtgatcggcgggatggtccttatctgtctgttcctctaccacgtcttccgcaacagaaactggctctag

SEQ ID NO: 180 - DNA, 432 bp, Mycobacterium Tuberculosis
gtgatcatccctgacatcaatctgctgctctacgcggtcatcaccggattcccgcagcaccggcgcgcgcatgcgtggtggcaagacaccgtcaacggccacacccgtatcgggctgacgtatccggcgttgttcgggttcctacggatcgccaccagtgcccgcgtgctcgccgcgccactgccaaccgcggatgcgatcgcctatgtgcgcgagtggctttcgcagccgaacgtggacctactcacggcgggtccgcgccacctggacatcgcgttgggcctgctcgacaagctcggcacagccagccacctaaccaccgatgtgcaactggccgcctacggcatcgaatacgacgccgagatccattccagtgacaccgactttgcccgattcgccgatctgaagtggaccgacccgttgcgcgaataa

SEQ ID NO: 181 - DNA, 1740 bp, Mycobacterium Tuberculosis
atgactacggcgatacgccgggcggccgggagcagctacttccgaaacccctggcctgcgctgtgggcgatgatggttggcttcttcatgatcatgctcgactccaccgtcgtagccatcgcgaatccgaccatcatggcccagctacgcatcggttacgccaccgtggtttgggtgaccagcgcctatctgctggcctacgcggtgccaatgctggtggccggccggcttggcgaccggttcggcccgaagaatctctacctgattggcctgggggtattcaccgttgcgtcgctggggtgcggtctgtcgagcggtgccggcatgctgattgccgctcgagtggtgcaaggcgtcggcgccggattgcttaccccgcagacgctgtcgacgataacgcggatcttcccggctcatcgccgcggtgtcgcgctgggcgcatggggcaccgtcgccagtgtcgccagcctggtgggaccgttggccggcggcgcgctggtcgacagcatggggtgggagtggattttcttcgtcaacgttcccgtcggcgtcatcggcctgatcctggcggcctatctgattccggcactaccccaccacccgcatcggttcgattggttcggcgtcggattgtctggtgcgggaatgtttctgattgtcttcggactacagcagggccagtccgccaattggcagccttggatttgggcggtgatcgtcggcggtatcgggtttatgtcgctgttcgtttactggcaggcgcggaacgcccgcgagccgctgatcccactggaggtcttcaacgaccggaacttcagcttgtccaacctcaggatagcgatcatcgccttcgcggggacggggatgatgctgccggtgacgttttatgcgcaggcggtgtgtgggttgtcgccgacccacacggccgtgctgttcgcgccgacggcgatcgtcggtggcgtgctggccccgttcgtcggcatgatcattgacaggtcccatccgttgtgcgtactgggtttcggcttctcggtgctggcgatcgcaatgacatggctcttatgcgagatggctccgggcacgcccatctggcggctggtgttgccgttcatcgcgttaggcgttgctggggcgttcgtgtggtcgccgctgaccgtcaccgcgacccgcaatctacggccgcacctggccggtgcgagctcaggtgtgttcaacgccgtccggcagctgggggctgtgctggggagcgcgagcatggccgcgttcatgacgtcgcgcatcgccgccgagatgcccggtggtgtggacgcccttaccggtcccgccgggcaggacgctaccgtgttgcagctgcccgagttcgtgcgcgaacccttcgcggccgcgatgtcgcaatcgatgctgttgcccgccttcgtcgccctattcgggatcgttgccgcgttgttcctggttgacttcaccggtgctgcggttgccaaagagccgttgcccgaatccgatggcgacgctgacgacgacgactatgtcgagtacatccttcgtcgggaaccggaagaggattgcgacacccagccgctgcgggcgtcgcgcccggcagcggccgcagcgtcacgcagcggtgctgggggtccgctggcggtcagctggtcgacgtcagcccaaggaatgcccccaggtccaccaggccgtcgggcgtggcaggcagatactgagtcaacagctccgagcgcactataa

SEQ ID NO: 182 - DNA, 1692 bp, Mycobacterium Tuberculosis
atggccttcccggaatattcgcctgcggcgtccgctgcgacgtttgctgacctgcagattcatccccgcgtcttgcgggcgatcggcgacgtcggttacgagtcaccgacggctatccaggcggctacgatcccggcgttgatggcaggctccgacgtggtggggctggcgcagaccggcaccggcaagacggcggcatttgcgattccgatgctgtccaagatcgacatcaccagcaaggtgccccaggcgctggtgctggtgcccacccgggagctggctctgcaggtggccgaggcgttcggccgctacggtgcctatctgtcgcaactcaacgtgctgccgatctacggcggatcgtcgtatgccgtgcaactggccggattgagacgcggcgcgcaggtggtggttggcacccccggtcgtatgatagaccatctcgaacgggcgaccttggacctgtcgcgggtggactttctagtgctcgatgaggccgatgagatgctgaccatgggtttcgccgacgacgttgagcgcattctgtccgagacccccgaatacaagcaggtcgccctgttttccgcgaccatgccgccggcgatccgcaaactcagcgccaagtatctgcacgatccgttcgaagtcacttgtaaggcgaaaaccgctgtggccgagaatatttcgcagagctacattcaggtagcacggaagatggacgcgctcaccagagtgctcgaagtcgagccgttcgaggcgatgatcgtctttgtccgcaccaagcaggcgaccgaggagattgccgaaaagctgcgtgcccgagggttttccgcggctgccatcagcggtgacgtcccgcaggcgcagcgggagcggaccatcacggcgctgcgggacggcgacatcgatatcctggtcgccaccgatgtggcggcgcgcggactcgacgtggagcggatatcacacgtgcttaactacgacatcccgcacgacaccgagtcctacgtacaccggatcgggcgcaccggcagggccgggcgttcgggagccgcgctgatattcgtctcgccacgggagcttcacctgctcaaggcgatcgaaaaggctacgcggcaaacgcttaccgaggcgcaattgcccaccgtcgaggatgtcaacacccagcgggtggccaagttcgccgattccatcaccaatgcgctgggcggtccgggaatcgagctgttccgccgactggtcgaggagtatgaacgcgagcatgatgtcccgatggctgacatcgccgcggcactggccgtgcagtgccgcggcggtgaggcattcctgatggcacccgacccgccgctttcgcggcgcaaccgcgaccagcgtcgggaccgtccgcaaaggcccaagcgtagaccggacttgaccacctaccgcgtcgccgtcggcaagcggcacaagatcggtccaggcgccatcgtcggcgccatcgccaatgagggtgggctgcaccgcagcgacttcggtcagatccgtatcgggccagacttctcgctagtagaattgccggcgaagctgccccgcgcgacgctcaaaaagcttgcacagacccgtatctcgggtgtgctgatcgaccttcggccataccggccgcccgacgcggcgcgccggcataatggcggcaaaccacggcggaaacacgtcggatga

SEQ ID NO: 183 - DNA, 1152 bp, Mycobacterium Tuberculosis
atgaccctgcccaaggaaagagccgcccagggcggactcgagcggatcgcccacgtggaccgggtggcgtcgttgaccgggatccgtgctgttgccgcattgctggtcgtcggcactcatgcggcctacaccaccggcaagtacacccacggctattggggcctgatgtcgtcccgcatggagatcggcgttccgatctttttcgtgctgtcggggttcctgctattccggccatgggttaagtccgccgctaccggcggccccccgccgtcgttgagccgctatgcgtggcaccgggtccggcggatcatgcccgcctacaccgtcaccgttctgttggcctacctcgtctatcacttccgcacggcggggcccaaccccgggcacacctgggtcgggctgttccgcaacctcaccttgacgcagatctataccgacggctatctgggtgcgttcctgcatcagggtctgacccaaatgtggagcctcgcggtggaggttgccttctacctggcgttgccggcgttggcatacctactgttggtgctcgtctgccggcggcgatggcagcccaggttgctgttggccaccatggcggggctgacgatgatcagcccggcatggttgatcctggtgcacaacacgcactggatgcccgacggcgctcggctgtggctacccacctatctggcttggttcgtcggcggcatgatgctggccgtgctggcggcgatgggcgtgcgctgttatgcattcgtggccataccgttggcggtcatctgctacttcatcgtctccactccgatcgcgggcgcgcccacgacgtcgcccacagcgctggccgaggcgctggtcaagaccgccttctatgccgtgatcgccgtgctggcggtggcaccgctggccttgggtgaccaggggtggtatgcccagttgctggccagccggccgatggtgtttcttggtgagatctcctacgagatcttcctgatccatctggtgaccatggagatcgccatggtggacgtgctcgggtatcgggtttacaccagttcgatggtgaacctttgtctcgtgacgctggtgctgacgatcccattggcgtggttgttgcaccgtttcactcgggtccagggtgaccggccttcctag

SEQ ID NO: 184 - DNA, 609 bp, Mycobacterium Tuberculosis
atggcgggtaccgactggctgtccgcgcgtcggaccgagttagccgcagatcggatactcgacgccgccgagcgactctttacgcagcgtgacccggcgtcgatcggcatgaacgagatcgccaaggccgcaggctgttcgcgcgcaacactgtatcggtacttcgacagccgcgaggcgctgcgaaccgcgtacgtgcaccgcgagacccgccggctcggccgcgagatcatggtgaagatcgccgatgtcgtcgaacctgccgaacggctgctggtgagcatcaccacgacgttgcggatggtccgcgacaaccccgcgttggccgcgtggtttaccaccacccgcccaccgatcggcggcgagatggccggacggtccgaggtgatcgcggccctggccgcggcattcctcaactcactaggtcccgacgatccgaccaccgtcgaacgccgcgcccgctgggtggtccggatgctcacatcgctgctgatgttccccggccgtgacgaagccgacgaacgagcgatgatcgcggagttcgtcgtcccgatcgtgacacctgcttctgccgccgctaggaaggccggtcaccctggacccgagtga

SEQ ID NO: 185 - DNA, 375 bp, Mycobacterium Tuberculosis
atgacgacgatgattactcttcggcgacggttcgcggtggccgtcgccggcgtcgccactgccgccgcgacgaccgtcaccctggctcccgcaccagcaaatgccgccgatgtctatggcgcaattgcctactccggcaacggctcgtggggccgatcgtgggactacccaacccgggcggctgccgaagccaccgccgtcaagtcgtgtggctactccgactgcaaggtgctcaccagtttcaccgcctgcggcgccgtcgccgccaacgatagggcataccagggaggagttggacccaccttggccgccgccatgaaggacgccctgaccaagctcggcggcggctacatcgacacctgggcctgcaactaa

SEQ ID NO: 186 - DNA, 1896 bp, Mycobacterium Tuberculosis
gtgaccgcgccaccgggcgcacgcccccgtgccgcaagcccgcccccgaacatgcggtcccgcgacttctggggatcggcagcccgactggtgaaacggctggcgccacaacgccggctgagcatcgcggtgatcacactgggaatcgccggcacgacgatcggcgtcatcgttccacggatcctcggccatgccaccgatttgctgttcaacggcgtgatcgggcgagggctaccggggggaatcaccaaggcacaggccgtcgcttcggctcgggcccgtggtgacaacaccttcgccgacctgctgtccgggatgaacgtggtgccgggccaaggtgtggacttcgccgcggtggagcgaacactggcgctggcgttggcgctgtatctggctgcagcgctgatgatttgggcacaagcccggctgctcaacctcaccgtgcagaaaacgatggtcaggttgcggaccgatgtcgaagacaaggtgcaccggctgccgctgtcctacttcgacggacaacagcgcggtgagctgctgagccgggtcaccaatgacatcgacaacctccagtcgtcgctgtcaatgacgatcagccagctggtgacgtcgattctgaccatggtggcggtgctggccatgatggtgtcgatctcgggcctgctggcgctgatcacactgctgacggtgccgctgtcgctgctggtgacacgcgcgatcacccggcggtcacagcccctattcgtagctcactggaccagcaccgggcgcctcaacgcccatctcgaagagacctacagcgggttcacggtagtcaagacgttcggccaccaagcggccgcacgagaacggttccacgagttgaatgacgacgtctaccaggccggtttcggcgcccagttcctctctggtctcgtgcagccggcgacggcgttcatcggcaacctcggctacgtcgcggtcgcggtggccggtggcctgcaggtagccaccgggcagatcacgctcggcagcatccaggcgttcatccagtacatccgccagttcaacatgccgctgagccagctggccgggatgtacaacgccctgcagtccggggtggccagcgcggagcgggtgttcgacgtgctcgacgagcccgaggagtcgccggagcctgagccggagctgccgaacctaaccggacgggtcgagtttgagcacgtgaactttgcttacctcccgggcacgccggtgatccgcgacctgtcgctggtggccgaaccgggtagcacggtggcgatcgtcggaccgacgggagccggcaagaccacgctggtgaacctgctaatgcggttctacgagatcggttccggacgaatcctgatcgacggggtggatatcgcctcggtaagccggcagtcgctgcgatcgcgaatcggcatggtgttgcaagacacctggctctacgacgggaccatcgcggagaacatcgcctacggacggccggaggccaccacagacgagatagtagaagccgccagggcggcccatgtcgaccggtttgtgaacacactgcctgctggctaccagacacgggtcagcggcgacggcggcagcatcagcgtcggcgagaagcaactcattaccatcgcccgcgcctttcttgcccgcccgcagctgttgatcctggacgaggcgaccagctcggtcgatacccgcaccgagctgctcatccagcgagcgatgcgcgagcttcgccgggatcgtacgagtttcattatcgcccaccgactttcgacgattcgcgatgccgaccacatcctggtggtccagaccggccagatcgtcgaacgcggcaaccacgccgagctgttggcccggcgcggggtctattaccagatgacgcgggcctag

SEQ ID NO: 187 - DNA, 492 bp, Mycobacterium Tuberculosis
gtgacggttaccgacgactacctggccaacaacgtggactacgcgagcggtttcaagggcccgctaccgatgccgccgagcaaacacatcgcaatcgtggcgtgcatggacgcccggctggacgtctaccgcatgctgggcatcaaggagggcgaggcacacgtcatccgcaacgccggatgcgtggtcaccgacgatgtgatccgttcactggccatcagccagcggctgctgggaacccgcgaaatcatcctgctgcaccacaccgactgtgggatgctgactttcaccgacgacgacttcaagcgcgccatccaggacgagaccggcatcagacccacgtggtcgcccgagtcgtaccccgacgccgtcgaggacgtccgtcagtcgctgcgccgcatcgaggtcaacccgttcgtcaccaagcacacgtcgctgcgcggcttcgtcttcgatgtcgccaccggcaaactcaacgaggtcacgccctag

SEQ ID NO: 188 - DNA, 1326 bp, Mycobacterium Tuberculosis
gtgcccggtgacgaaaagccggtcggcgtagcggtactcggtttgggcaacgtcggcagcgaggttgtccgcatcatcgagaacagcgccgaggatctcgcggctcgtgtcggtgccccattggtcctgcggggcatcggcgtgcgccgcgtgacgaccgatcgcggcgtgccgatcgaattgttgaccgacgacattgaagagctcgtggcccgcgaggatgtcgatatcgtggtggaagtgatggggccggtggaaccgtcgcgcaaggcgatcctgggcgcccttgagcgcggcaagtccgtcgttacggcgaacaaggctttactcgccacctccaccggcgaattggcacaggccgccgaaagcgcccatgttgatctgtatttcgaggcggccgtggcgggcgccattccggtcatccgtccgctcacccagtcgctggccggcgacacggtgctgcgagtggccgggatcgtcaacggcaccaccaactacatcctctcggcgatggacagcaccggcgctgactatgccagcgccctggccgacgcaagtgcgctgggctatgcggaggctgatcccaccgcagacgtcgaaggctacgacgccgcggccaaggcagcgatcctggcatccattgccttccacacccgggtgaccgcagacgacgtgtatcgcgaaggcatcaccaaggtcactccggccgacttcggatccgcgcacgcgctgggttgcaccatcaaactgctgtcgatctgtgagcgcataaccaccgacgaaggttcgcagcgggtatcggcccgcgtctatccggccctggtacctctgtcgcatccgcttgccgcggtcaacggcgcgttcaatgccgtggtggtcgaggccgaggccgcgggccggctgatgttctacggccagggcgcgggcggcgcgccgaccgcctctgcggtgaccggtgacctagtgatggccgcccgcaaccgggtactcggcagccgcggcccccgtgagtctaaatacgctcaacttccggtggcaccaatgggtttcattgaaacgcgctattacgtcagcatgaacgtcgccgacaagccgggcgtcttgtccgcggtggcggcggaattcgccaaacgcgaggtgagcatcgccgaggtgcgccaggagggcgttgtggacgaaggtggtcgacgggtgggagcccgaatcgtggtggtcacgcacctcgccactgacgccgcactctcggaaaccgttgatgcactggacgacttggatgtcgtgcagggtgtgtccagcgtgatacgactggaaggaaccggcttatga

SEQ ID NO: 189 - DNA, 1809 bp, Mycobacterium Tuberculosis
gtgaccgatacggacctcattacggctggcgaaagtaccgacggcaagccgtcggatgccgctgccacagatcccccagacctcaacgccgacgagccggccggctcgctggccaccatggtgctgcccgaactgcgtgcgctggctaatcgagccggcgtgaagggaacatcgggtatgcggaagaacgaactgatcgctgcgattgaggagatcaggcgacaggccaacggcgccccagccgttgaccggtcggctcaagagcacgacaagggcgaccggccgcccagttccgaggcaccggccacccagggggaacagaccccgaccgaacagatcgattcccaaagccaacaggtccgcccggagcggcgcagcgccacccgtgaagcgggaccctccggttccggtgagcgtgcgggcacagccgcagacgacaccgacaaccgccaaggcggtcaacaggacgccaagaccgaggagcgtggcaccgacgcgggtggcgaccaagggggtgaccagcaggcttcgggcggtcagcaggcgcgcggcgacgaggacggagaagcgcgtcagggccggcgcggacgccggttccgcgatcggcggcgccgcggtgaacgatccggcgacggcgccgaggctgaactgcgtgaggacgacgtcgtccagccggtagccggcatactcgacgtcctggacaactacgcgtttgtgcgcacctccggctacctacccggtccgcacgacgtgtatgtgtcgatgaacatggtgcgcaagaacggcatgcgccgtggtgatgcggtgaccggtgcggtgcgggtgcccaaggaaggggagcaacccaaccagcggcagaagttcaacccgctggtccgcctggacagcatcaacggcggatcggtcgaagacgccaagaagcggcccgagttcggcaaactgacgccgttgtaccccaaccagcggcttcgtctggaaaccagtaccgagcggctgaccacccgggtcatcgacctcatcatgccgatcggcaagggtcaacgcgcgttgattgtgtcgccgcccaaagcgggcaagacaacgatcctgcaggacatcgccaacgcgatcaccaggaacaacccggaatgccacctcatggtcgtgctcgtcgacgagcggcctgaggaggtcaccgatatgcagcgctcggtcaaaggcgaggtcatcgcttcaactttcgaccggccgccgtcggaccacacgtcggtcgccgagctggcgatcgaacgcgccaagcggctggtggagcaaggcaaggacgtcgtggtgctgctcgattcaatcacccggctaggccgcgcttacaacaacgcgtcgccggcgtcgggccggatcctgtccggtggtgtcgattccacggcgttgtacccgcccaagcgcttcctgggggccgcgcgcaacatcgaagagggcgggtcgctgaccatcatcgccactgcgatggtcgagaccgggtccactggtgacacggtcattttcgaggagttcaagggcaccggcaacgccgagctcaagctggaccgcaagatcgccgagcggcgggttttccctgcggtcgacgtgaacccttctggaacccgcaaggacgagctactgctgtcgcccgacgagttcgctattgtgcacaagctgcgccgcgtgctatcgggcctggattcccaccaggccatcgacctgctgatgtcgcagctgcgtaagacgaagaacaactacgaattccttgttcaggtgtccaagaccacgccagggtccatggacagcgactga

SEQ ID NO: 190 - DNA, 486 bp, Mycobacterium Tuberculosis
gtgacgacaccagcgcaggacgcgccgttggtgtttccctctgttgctttccgtccggttcgcctttttttcatcaacgttggactggccgcagtggcgatgttggtcgccggcgtgttcggtcacctgacggtcgggatgttcttgggtctcgggttgctgctgggtttgctcaatgccctgctggtgcggcgttcggccgagtcgatcaccgccaaagagcacccgttaaaacggtcgatggccctcaactcggcatcgcgactggcgattatcaccatcctcgggctgatcatcgcctacattttccggcccgctggattgggcgtcgtgttcgggctggcattcttccaggtgctgctggtggcaacgacggccctgccggtcctgaagaagctgcgcactgcgaccgaggaaccggtcgcaacttattcttccaatggccagaccgggggatcggaaggaaggagcgccagcgatgactga

SEQ ID NO: 191 - DNA, 753 bp, Mycobacterium Tuberculosis
atgactgagaccatcctggccgcccaaatcgaggtcggcgagcaccacacggccacctggctcggtatgacggtcaacaccgacaccgtgttgtcgacggcgatcgccgggttgatcgtgatcgcgttggccttttacctgcgcgccaaagtgacttcgacggatgtgccaggcggggtgcagttgttttttgaggcgatcaccattcagatgcgcaatcaggtcgaaagcgccatcgggatgcggatcgcacccttcgtgctgccgctggcggtgaccatcttcgtgttcatcctgatctccaactggctggcagtcctcccggtgcagtacaccgataaacacgggcacaccaccgagttgctcaaatcggcagcagcggacatcaattacgtgctggcgctggcgcttttcgtgttcgtctgctaccacacggccggtatttggcggcgcggtattgtcggacacccgatcaagttgctgaaagggcacgtgacgctcctcgcgccgatcaaccttgtcgaagaagtcgccaagccaatctcgttgtcgctccgacttttcggcaacattttcgccggcggcattctggtcgcactgatcgcgctctttcccccctacatcatgtgggcgcccaatgcgatctggaaagcatttgacctgttcgtcggcgcaatccaggccttcatttttgcgctgctgacaattttgtacttcagccaagcgatggagctcgaagaggaacaccactag

SEQ ID NO: 192 - DNA, 516 bp, Mycobacterium Tuberculosis
atgggtgaagtgagcgcgattgtcctggccgccagtcaggcggcagaggaaggcggcgagtccagcaacttcctcattcccaacggcacgtttttcgttgtgctggccatcttcctggtggtgctcgctgtcattggcactttcgtggtgccgccgatcttgaaggtcttgcgggaacgtgacgctatggtcgccaaaacgctggccgacaacaagaagtcggacgagcagttcgccgccgcacaggccgattacgacgaagccatgacggaagcccgagtccaggcgtcgtccttgcgcgacaatgcccgggcagatggccgtaaagtcatcgaggacgcacgcgtccgggccgaacaacaggtggcatcgacgttgcagaccgcccatgagcaattgaagcgggagagggacgccgtggaactcgatctgcgtgcccacgtgggcaccatgtcggcgactctggccagtcgaattctcggtgttgacctcaccgcttcagccgcgacgaggtaa

SEQ ID NO: 193 - DNA, 582 bp, Mycobacterium Tuberculosis
atggcagtccacctgacccgcatctatacccgaaccggcgatgacggaacgacgggattgagcgatatgtcccgtgtcgccaaaaccgacgcccgactggtggcatacgcggattgcgacgaggccaacgccgcgatcggggccgccctggcgctgggccacccggacactcaaatcacggatgtgctgcggcagatccagaacgacttgttcgatgccggtgcggatctgtcgactccgatagtggaaaacccgaagcaccctccgctgcgaatcgcacagtcctatatcgatcggctcgaagggtggtgcgacgcatacaacgcgggcctgcctgcactaaaatcctttgtactacctggtggttcaccgctgtcggcgctgttgcacgtcgctcgcaccgtcgttcgccgggccgagcgatccgcgtgggccgcggtcgacgctcacccggaaggcgtcagcgtactgccggcgaaatacctgaaccggctgtcggatctgctgttcatcctgtcgcgggtagccaatcccgacggtgacgtgctgtggcggcccggtggtgataggacggcgagctag

SEQ ID NO: 194 - DNA, 498 bp, Mycobacterium Tuberculosis
atgattcactaccgcaccatcgatagccccatcgggccattaaccctggccgggcatggctcggtgttgacgaacctgcggatgctcgagcagacgtatgagccaagccgcacacactggacacccgaccccggcgcattttctggcgctgtcgaccaactcaacgcttatttcgccggcgagctcaccgaattcgatgtggaacttgacctccggggaaccgactttcagcaacgagtatggaaagcattgctgacaatcccgtacggggaaacccggtcctacggggaaatcgccgaccagatcggcgcccccggcgccgcacgcgccgtgggattggccaacggccacaatcccatcgccatcatcgtcccgtgccaccgcgtgatcggcgccagcggaaagctcaccgggtacggcggtggaatcaaccggaaacgagctctgctcgagttggagaaaagccgggcgcccgcagacttgacgctcttcgactga

SEQ ID NO: 195 - DNA, 1491 bp, Mycobacterium Tuberculosis
gtgcacgacgacttcgaacgctgctaccgggcgatccagtccaaagacgcccggttcgacggctggttcgtcgtcgcggttttgaccaccggtgtctactgccggccgagttgccccgtccggccaccgttcgcgcgcaatgtccggttcctgccgactgcggcggccgctcagggggagggattccgggcctgcaaacggtgccgccccgacgcctcgcctgggtctccggaatggaatgtgcgtagtgacgtcgtggcgcgggcgatgcggctgattgccgacggaacggtggaccgcgacggtgtcagcggcctcgcggcccagctcggttacaccattcgccagctggagcggctgttgcaggccgtggtcggcgccggtccgctcgcgttggcccgcgcccaacgcatgcagaccgcccgggtgctgatcgagaccacgaacctgccgttcggcgatgtcgcattcgccgccgggttttccagcatccgtcagttcaacgacaccgttcgcctggcgtgcgacggcacaccgacggcattgcgtgcgcgcgcggccgcccgattcgagtctgccaccgcatcagcgggcacggtgtcgctgcggctacccgtccgtgcaccattcgccttcgagggtgttttcggccatctggccgccaccgcggtgccgggttgcgaagaggtccgcgatggtgcgtaccgacgcacgctacggctcccatggggcaacggcatcgtcagcctgacgccggcacccgatcatgtgcgctgcctgcttgtgctcgatgatttccgcgacctgatgacggccactgcacgttgccgacggctgctggacctcgacgccgatcccgaagcgatcgtcgaggcgctgggcgccgatccggatctgcgcgcagtggtgggcaaggcacccgggcaacgcattccccgcacagtcgacgaggcagaattcgccgtgcgggcggtcctcgcccaacaggtatcgacgaaggccgcaagcactcacgcgggccgactggtcgccgcctacggacggccggtccacgatcgccacggcgctttgacccacaccttcccgtcgatcgagcagctcgctgagatcgatcccggccatctggccgtccccaaggcgcgtcaaaggaccataaacgcgctcgtcgccagccttgccgacaaaagtctggtcctggacgccggatgtgactggcaacgcgcccgcgggcagttgctagcgctgcccggagtgggcccctggaccgcggaggtcatcgccatgcgcggcctcggtgacccggacgcctttccggccagtgatctcggcctgcggctggccgccaaaaagctgggcctgcctgcacaacgacgagccctgacggtgcacagcgctcgctggcgcccctggcgctcctatgccacccagcacctgtggaccaccctggaacatccggtaaaccaatggccaccgcaggagaagatcgcatga

SEQ ID NO: 196 - DNA, 297 bp, Mycobacterium Tuberculosis
atggctcggcgccgcaaaccgctgcaccggcagcggccggaaccgccgtcgtgggccctgcgccgagtggaagcggggcccgatggccacgagtatgaagtacgaccggtcgctgcggcccgcgccgtcaagacctatcgctgtccggggtgtgatcacgaaatccgttccggtactgcacatgtggtagtgtggccgactgacttgccgcaagccggcgtcgatgaccggcgtcactggcacaccccgtgctgggcgaaccgagcaacccgcggtccgactcgaaaatggacctag

SEQ ID NO: 197 - DNA, 2106 bp, Mycobacterium Tuberculosis
gtgagtggccgggcaatcggaacggaaacggagtggtgggtgcccggtcgtgtcgaaatcgatgacgtcgcgcccgtcgtttcgtgcggcgtatatcccgccaaggcggtggtcggcgaggtggtcccggtcagcgcggcggtctggcgtgaaggccacgaggccgtcgcagcgacgctggtcgtgcgctacctcggagtgcgttacccacacctcaccgacagaccccgggccagggtgcttccgacgccgagcgagccccaacaacgcgtcaagccgctgctgatcccgatgacgagcggccaggagcccttcgttttccacggccagttcacccccgaccgggtcggattgtggaccttccgggtggatggttggggtgacccgatccacacctggcgccatgggctgatagccaagctagatgccggccagggagagaccgagctgtccaacgacctgttggtaggcgcggtgctgttggagcgcgcggcgaccggtgtgccgcgcgggttacgcgatcccctcctggcggccgcggcagcgctgcggacccccggtgacccggtgacccgcaccgcgttggccctgacaccggaaatcgaagagctgctggccgactatccgctgcgggacctggtcacccggggcgagcaattcggcgtctgggtggatcggccgttggcccggttcggcgcttggtatgagatgtttccgcgctcaaccggcgggtgggacgacgacggcaacccggtacacggcaccttcgccaccgctgcggcagaacttccgcgcatcgccggcatggggttcgacgtggtgtacctgccgccgatccatccaattggcaaggtgcatcgcaagggtcgcaacaactcgcccaccgccgcaccgacagacgtgggatcgccgtgggcgatcggtagcgatgagggcggtcacgataccgttcatcccagcctgggcaccatcgacgacttcgacgacttcgtctccgcggcacgcgatctgggcatggaggtcgcgctggacctggcgctgcaatgcgcaccggatcatccgtgggcccgcgaacaccggcagtggttcaccgagctgccggacggcaccatcgcctacgcggagaatccaccgaagaagtaccaggacatctatccgctcaacttcgacaacgatcccgagggcctgtacgacgaagtgctgcgcgtggtgcaacattgggttaaccacggcgtcaagttctttcgcgtcgacaatccccacaccaaaccacccaacttctgggcctggctgatcgcgcaggtgaagaccgtcgaccccgacgtgctgttcctgtccgaggctttcaccccgcccgcccgccagtacgggctggccaagctcggcttcacgcagtcctacagctatttcacctggcgcacgaccaagtgggagctcaccgaattcggcaaccagatagccgaactcgccgactaccgtcggcccaacctgttcgtcaacaccccggacatcctgcacgcggtgctgcagcacaacggtccaggcatgttcgccatccgcgcggtgctggccgccaccatgagcccagcctgggggatgtactgcggttatgagcttttcgagcaccgtgcggtgcgcgagggcagcgaggagtacctggactcggagaagtacgaattgcgtccccgcgactttgccagcgcgctggaccagggtagatctttgcagccgttcatcacacggctcaatataattcgccggctgcacccggcgtttcaacagttgcgtaccattcattttcaccacgttgacaacgacgcgttgctggcctacagcaagttcgacccggccaccggcgactgcgtgttggtggtggtgacactcaacgcatttggtcctgaagaagctacgctgtggttggacatggcggcgttgggcatggaggactacgaccggttttgggtgcgcgacgagataaccggcgaagaataccaatgggggcaagccaattacatccgcatcgacccagcacgggcagtcgcccacatcatcaacatgccagccgtgccctacgagagccgaaacacgctgctgcgcaggaggtga

SEQ ID NO: 198 - DNA, 2592 bp, Mycobacterium Tuberculosis
gtgaaagcccttcgccggtttaccgtccgagcccacctacccgaacgtcttgccgccctggaccagctgtctaccaatctgcggtggtcctgggacaaaccgacacaggatctgttcgcggcgatcgaccctgcactgtgggagcaatgcggtcatgatccggtggcgctgctgggcgcggtgaacccagcgcgtctcgacgaacttgcgctggacgcagaatttttgggcgccctcgatgagctggcggccgacttgaacgactacctgagccgtccgctgtggtatcaggagcagcaggacgccggggtagccgcacaagccctgccgaccgggatcgcgtacttctcgctggagttcggggtagccgaggtgttgcctaattactcgggcggtcttgggattctcgccggcgaccatctgaaatccgcgtccgatctgggcgtgccgctgatcgcggtggggttgtactaccgctccggctacttccggcaatcgcttaccgcggacggctggcagcacgagacctacccatcgctggacccgcaagggctgccgttgcgtctgctcaccgacgccaacggggatccagtgctggtcgaggtcgccctgggagacaacgccgtgttgcgcgcccggatctgggtagcgcaggtgggtagggttccgttgctcttgttggattctgatatcccggagaacgagcacgacctgcgcaacgtcaccgaccgcctctacggtggcgaccaggaacatcgcatcaaacaagagatcctggccggcatcggcggggtgcgggcgattcgtgcgtacaccgccgtcgaaaagctcaccccgcctgaggtcttccacatgaacgagggccacgccggattcctcggcatcgaacgcatccgtgaactggtcaccgatgcgggtttggatttcgacaccgcattgactgtggtgcggtccagcacggtgttcaccactcatactcccgtccccgccgggatcgaccggttcccgctcgagatggtgcagcgctacgtcaatgaccagcgcggcgatggccggtctcggctgttgcctgggttgccggccgaccgcatcgtcgcgttgggcgccgaggacgatccggccaaattcaacatggcacacatgggcctgcggctggcgcagcgggccaacggcgtctcgttgctgcatggccgggtcagtcgtgccatgttcaacgagctgtgggcgggattcgaccccgatgaggtgccgatcggctccgtcaccaacggtgtgcacgcgcccacctgggcggcgccgcagtggttgcagctgggccgcgagctggccgggtcggactctttgcgcgagcccgtcgtttggcagcgactgcatcaggtcgatcctgctcatctgtggtggatccgctcacaactgcggtcgatgctggtggaggacgtccgggcgcggttgcggcaatcatggctggaacgtggtgcaacggatgccgaactgggttggatcgcgacggcattcgatccgaatgtgctcaccgtcggcttcgcccggcgggtcccgacctacaagcggctgacgttgatgttgcgcgatcccgatcggctcgagcaactgctgctcgacgaacagcggccgatccagctgatagtggctgggaagtcgcacccggccgacgacgggggcaaagcgctgatccagcaggtggtgcggttcgccgaccggccgcaggtccgccaccgcatcgccttcctgccgaactacgacatgtcgatggcccggctgttgtactggggctgcgacgtctggttgaacaacccgctgcggccgctagaggcgtgtggtacctcgggcatgaaaagcgcgcttaacggcgggctgaatttgtcgatccgtgacggctggtgggacgagtggtacgacggcgaaaacggttgggagataccgtctgccgacggtgtggcggacgagaaccgtcgcgacgacctggaggccggcgcgctctacgacctgctggcacaagccgtggcaccgaagttctacgagcgcgatgaacgcggggtgccgcagcggtgggtagagatggtccggcataccctacaaacgctcgggcccaaggtgctggcttctcgaatggtgcgcgactacgtcgagcattactacgcgccggcggcgcagtcttttcgccggaccgcgggcgcccagttcgacgcggcccgcgagctggccgactaccgccggcgcgcggaagaagcgtggcccaagatcgagattgccgacgtcgacagcaccggtctgccggatactccactgctcgggtcccagctgaccctgacggcaaccgtgcggctggccgggctgaggccaaacgacgtgacggtgcagggggtgctgggcagggtcgacgccggcgatgtgctaatggatccggtcaccgtcgagatggcgcataccggcaccggcgacggcggctacgagatcttctcgacgacgacgccgctgccgctggcggggccagtcggatacaccgtgcgggtgctgcctcgccacccgatgctggccgccagcaacgagctcggcctggtcaccctggcctga

SEQ ID NO: 199 - DNA, 1995 bp, Mycobacterium Tuberculosis
gtgtccgagtcggtatccatgtctgtgcctgagctgcttgccatcgccgtggcggcacttggcggcacccggcgtcgcggccagcaagagatggccgccgcggtagcgcatgcgtttgaaaccggtgagcacttggtggtccaggccggcaccggaaccggcaagtcgctggcgtatctggttcccgcgatcatccgcgctctttgcgacgacgcgccggtcgtggtgtcgacggcgacgatcgctttgcaacgtcaactcgtcgatcgtgacctgccccagctggtagattcgctcaccaatgcgctcccccgccgaccgaagttcgccctgctcaaaggtcgacggaactacctgtgcctgaacaagatccacaactcagtcacagccagtgaccatgacgacgagcggccgcaggaggagctcttcgacccggtggcggtcaccgcgctgggacgcgatgtgcaacggctaaccgcctgggcttcgacgaccgtgtctggtgatcgcgacgaccttaagcccggtgtgggagaccgatcctggtcgcaggtcagcgtttcggcgcgggaatgcctcggcgtggcccgctgcccgtttggctcggagtgcttctccgaacgggctcgtggagcggccggcctggccgatgtcgtcgtcaccaaccacgcgctgctggccatcgatgccgtcgccgaatcggcggtactgccagaacatcggctgctggttgtcgacgaggctcacgaattggccgaccgggtgacctcggtagccgccgctgagctgacgtctgccacgctcggtatggccgcacgacggatcacccggctggtcgacccgaaagtgacccagcggcttcaggcggcttcggctaccttcagttcggcgattcacgacgccagaccgggccgcattgattgcctcgatgacgagatggcgacctatctgagcgcgctgcgcgatgcggccagtgcggcgcgctcagcgatcgataccggcagcgacaccacgacggcgtccgtgcgcgccgaagcgggcgcggtactgaccgaaatatccgataccgcgtcacgaatcctggcgtcgttcgcccccgctatccctgaccgcagcgacgtggtttggctggagcacgaggacaaccacgaatcggctcgcgcggtgctgcgggtggctccgctatcggtggccgagctgttggccacccaggtgttcgcccgtgcaacgaccgtattgacctcggcaacgctgacaatcggcgggtcgtttgacgcgatggccacggcatggggcctgactgcagacacgccctggcgtggcctggacgtgggctcgcctttccagcacgcaaagtcgggaatcctctacgtggccgcccatctcccgccgccgggccgagacggcagcggctcggccgaacaactgaccgagatcgccgaactcatcaccgctgcaggtgggcgcaccctggggctgttctcgtccatgcgggccgcccgggcagccaccgaggccatgcgcgaacggctgtccacgccggtgttgtgtcagggcgacgacagtacgtccacgctggtggagaagttcaccgccgatgcggcgacctccctgttcggcacgctgtcgctgtggcagggggtcgacgtgccgggaccgtcgctgtcgttggtgttgatcgaccgcatcccgttcccccggccggacgatcccctgctgagtgcccgccagcgtgcggtggccgcccgtggcggcaacggcttcatgacggtcgccgccagccacgcggcgctgctgctggcacagggatccggccggctgttacggcgcgtcaccgatcggggcgtggttgcggtgctcgattcacggatggctaccgcccgctatggcgaattcctgcgagcctcgctgccgcccttttggcagaccaccaacgccacgcaagtgcgcgcggccctgcggcgccttgcgcgagcagacgcaaaagcccactaa

SEQ ID NO: 200 - DNA, 657 bp, Mycobacterium Tuberculosis
atgccgccggtttgtgggcgacgatgcagcaggaccggtgagattcgaggatattcgggatccatcgtgcgcaggtggaagcgcgtcgagacccgcgatggtccccgctttcgatcgtcgttggctccgcatgaggccgccctgctcaagaacctggcaggcgcgatgatcgggctgctcgacgatcgcgactcttcttcgccgtcagacgaactcgaggagatcaccggcatcaagaccgggcatgcgcagcgtccgggtgacccgaccttgcgtcggctgttgccggatttctaccgtcccgatgacctggatgacgatgatccgacggccgtcgacggctccgagagcttcaacgctgccctgcgcagcctgcacgaacctgagattatcgacgccaaacgtgttgccgcgcagcagttattagacacggttccggacaatggcggccggttggagctgacggaatccgacgccaatgcttggatcgccgccgtcaacgaccttcggctggcgctcggagtgatgcttgagatcggcccgcgtgggccggagcgcctgccggggaaccacccgttggccgcgcacttcaatgtctaccagtggctgacagtcctgcaggaatacctcgtgctggtgctgatggggtctcgatga

SEQ ID NO: 201 - DNA, 780 bp, Mycobacterium Tuberculosis
gtgtccaagcgagaagacggccggctcgaccacgagcttcgcccggtgatcatcacccgcggtttcaccgaaaacccggcgggatcggtgctcatcgaattcggtcacaccaaggtcctgtgcaccgccagcgtcaccgaaggggtgccccggtggcgtaaagcaaccggtctggggtggctcaccgcggagtacgccatgctgccgtcggccacccacagccgctctgatcgcgagtcggtgagaggcaggcttagcgggcgtactcaggaaatcagtcggctcatcggccggtcgctgcgcgcatgcatcgacctggcggcgctgggggagaacacgatcgctatcgattgtgatgtgttgcaggccgatggtggcactcgaaccgcggccatcaccggcgcctacgtggcattggccgacgcagtgacctacttgtcggcggcgggtaagttgtccgaccccaggccattgtcgtgtgccatcgccgcggtcagcgtcggtgttgtcgacggcaggatccgggtggatctgccctacgaggaagattcgcgcgccgaggtcgacatgaacgtcgtcgctaccgacaccggaaccctggtagagattcagggcaccggcgaaggcgcgacgttcgcacgttcgacactggataagctgctggacatggcactgggcgcctgcgacacgttgtttgccgcacaacgcgacgcgttggcgctgccgtatccgggtgtgctgccgcagggaccgccaccgccgaaggcgtttggcacctga

SEQ ID NO: 202 - DNA, 381 bp, Mycobacterium Tuberculosis
gtgtccactacccgccgtcgcagacccgcgctgatcgcgttggtgatcatcgcgacctgtggttgcctggccctgggttggtggcagtggaccaggtttcaatcgacctcgggcacctttcaaaatctgggttacgcgttgcagtggccattgtttgcttggttctgcgtctacgcgtaccgcaacttcgttcggtatgaagagacgcccccgcaaccgcccaccggcggcgccgccgccgagatacctgccggattgctgcccgagcggccgaagccggcgcagcagccacccgacgatcccgtactacgggaatacaacgcctacctagccgagctagccaaggacgatgccaggaagcagaacaggaccaccgcatga

SEQ ID NO: 203 - DNA, 1191 bp, Mycobacterium Tuberculosis
gtggtggacttcggggcgttaccaccggagatcaactccgcgaggatgtacgccggcccgggttcggcctcgctggtggccgccgcgaagatgtgggacagcgtggcgagtgacctgttttcggccgcgtcggcgtttcagtcggtggtctggggtctgacgacgggatcgtggataggttcgtcggcgggtctgatggtggcggcggcctcgccgtatgtggcgtggatgagcgtcaccgcggggcaggccgagctgaccgccgcccaggtccgggttgctgcggcggcctacgagacggcgtatgggctgacggtgcccccgccggtgatcgccgagaaccgtgctgaactgatgattctgatagcgaccaacctcttggggcaaaacaccccggcgatcgcggtcaacgaggccgaatacggggagatgtgggcccaagacgccgccgcgatgtttggctacgccgccacggcggcgacggcgaccgaggcgttgctgccgttcgaggacgccccactgatcaccaaccccggcgggctccttgagcaggccgtcgcggtcgaggaggccatcgacaccgccgcggcgaaccagttgatgaacaatgtgccccaagcgctgcaacaactggcccagcccacgaaaagcatctggccgttcgaccaactgagtgaactctggaaagccatctcgccgcatctgtcgccgctcagcaacatcgtgtcgatgctcaacaaccacgtgtcgatgaccaactcgggtgtgtcgatggccagcaccttgcactcgatgttgaagggctttgctccggcggcggctcaggccgtggaaaccgcggcgcaaaacggggtccaggcgatgagctcgctgggcagccagctgggttcgtcgctgggttcttcgggtctgggcgctggggtggccgccaacttgggtcgggcggcctcggtcggttcgttgtcggtgccgcaggcctgggccgcggccaaccaggcggtcaccccggcggcgcgggcgctgccgctgaccagcctgaccagcgccgcccaaaccgcccccggacacatgctgggcgggctaccgctggggcaactgaccaatagcggcggcgggttcggcggggttagcaatgcgttgcggatgccgccgcgggcgtacgtaatgccccgtgtgcccgccgccgggtaa

SEQ ID NO: 204 - DNA, 786 bp, Mycobacterium Tuberculosis
atggctgagacaaccgaaccaccgtcggacgcggggacatcgcaagccgacgcgatggcgttggccgccgaagccgaagccgccgaagccgaagcgctggccgccgcggcgcgggcccgtgcccgtgccgcccggttgaagcgtgaggcgctggcgatggccccagccgaggacgagaacgtccccgaggagtatgcagactgggaagacgccgaagactatgacgactatgacgactatgaggccgcagaccaggaggccgcacggtcggcatcctggcgacggcggttgcgggtgcggttaccaagactgtccacgattgccatggcggccgcagtcgtcatcatctgcggcttcaccgggctcagcggatacattgtgtggcaacaccatgaggccaccgaacgccagcagcgcgccgcggcgttcgccgccggagccaagcaaggtgtcatcaacatgacctcgctggacttcaacaaggccaaagaagacgtcgcgcgtgtgatcgacagctccaccggcgaattcagggatgacttccagcagcgggcagccgatttcaccaaggttgtcgaacagtccaaagtggtcaccgaaggcacggtgaacgcgacagccgtcgaatccatgaacgagcattccgccgtggtgctcgtcgcggcgacttcacgggtcaccaattccgctggggcgaaagacgaaccacgtgcgtggcggctcaaagtgaccgtgaccgaagaggggggacagtacaagatgtcgaaagttgagttcgtaccgtga

SEQ ID NO: 205 - DNA, 1428 bp, Mycobacterium Tuberculosis
atgggaaaccttgacctccttctccgcctctctggacggatcgttaaaggatgtcgaccgctcggcagcgtagcactcgcacgctgcgggcccgcggtgcggtggccgcggtggcccaggcctgctatactcgaacacatgttcgatttagtgagcctcgcgggcgtggattcgcgcgacgatgaggcgagcctgaccgcgcggatcgccgagctggagcgggtcaaatcggccgcggccgccggtcaggcacgtgctgcggcggcgctggacaagttgcgtcgctgcaatgaggcggatgcgggggtgccggcacggcggcgcgggcgtggggtggccagtgaagtagcgctggcgcgacgggattcgccggcgcgcggcgggcgccacctggggttcgcgaaggcgttggtgtatgagatgccgcacacactcgccgcgctcgaggtcgggcggctatcggagtggcgggccacgctgatcgtgcgggagtcggcctgcctggacgtcgaggatcgccgcgcactcgacgccgagctgtgcgccgacatgtccgcattggacgggatgggtgatgcgcggatcgccgccgcggcccgggcgattgcctaccggctcgatgcccaggcggtggtggagcgggccgccagggccgagaccgaacgcacggtgacgatccgcccggcccccgacaccatgacctgggtgacggcgttgcttccggtggcccgaggcgtgtcggtctatgcggcgctcaagcgggccgccgacacgacattcgacgatcggacacggggccaggtaatggccgacacgttggtcgagcgggtcaccggacaacccgccgaggcggcccaaccggtagcggtcaacctggtgctctccgacgagacactgttagctggcgaccgcgccccggcggtggtcgacgggtatggccccatcccggcggccgtggcccgcaacctggtgcgcgacgcggttgccgatacgcggtcacgggccacgctgcgccggctctaccgtcatccgcgctcgggggccttggtggcgatggaatcgcgggcacgccggttcccgaaggggctggccgcgttcatcgggttgcgcgatcagcgctgtcgcatgccctactgcgatgccccgatccgccaccgtgaccacgcccagccgcatcatcgaggcggcccgaccaccgcgaccaacggcctcggatcgtgtgaacgctgtaactacgtcaaggaagctcccggctggcgcgtcagcaccgacacggacgaaaccggccgtcacacagctgaattcaccacgcccaccgggatgtactatcactgcaccgcgccaccactgcccgggccgttggagatagacgttagccaggtggaagccagaatcggtgtcgccctcacccacctacacgccgcctaa

SEQ ID NO: 206 - DNA, 1620 bp, Mycobacterium Tuberculosis
atgaccgagccgtggatagccttccctcccgaggtgcactcggcgatgctgaactacggtgcgggcgttgggccgatgttgatctccgccacgcagaatggggagctcagcgcccaatacgcagaagcggcatcagaggtcgaggaattgttgggggtggtggcctccgagggatggcaggggcaagccgccgaggcgtttgtcgccgcgtacatgccgtttctggcgtggctgatccaagccagcgccgactgcgtggaaatggccgcccagcaacacgtcgtcatcgaggcctacactgccgcggtagagctgatgcctactcaggtcgaactggccgccaaccaaatcaagctcgcggtgttggtagcgaccaatttctttggcatcaacaccattcccattgcgatcaatgaggccgagtacgtggagatgtgggttcgggccgccaccacgatggcgacctattcaacagtctccagatcggcgctctccgcgatgccgcacaccagccccccgccgctgatcctgaaatccgatgaactgctccccgacaccggggaggactccgatgaagacggccacaaccatggcggtcacagtcatggcggtcacgccaggatgatcgataacttctttgccgaaatcctgcgtggcgtcagcgcgggccgcattgtttgggaccccgtcaacggcaccctcaacggactcgactacgacgattacgtctaccccggtcacgcgatctggtggctggctcgaggcctcgagttttttcaggatggtgaacaatttggcgaactgttgttcaccaatccgactggggcttttcagttcctcctctacgtcgttgtggtggatttgccgacgcacatagcccagatcgctacctggctgggccagtacccgcagttgctgtcggctgccctcactggcgtcatcgcccacctgggagcaataactggtttggcgggcctatccggcctgagcgccattccgtctgctgcgatacccgccgttgtaccggagctgacacccgtcgcggccgcgccgcctatgttggcggtcgccggggtgggccctgcagtcgccgcgccgggcatgctccccgcctcagcacccgcaccggcggcagcggccggcgccaccgcagccggcccgacgccgccggcgactggtttcggaggcttcccgccctacctggtcggcggtggcggcccaggaatagggttcggctcgggacagtcggcccacgccaaggccgcggcgtccgattccgctgcagccgagtcggcggcccaggcctcggcgcgtgcgcaggcgcgtgctgcacggcggggccgctcggcggcgaaggcacgtggccatcgtgacgaattcgtcacgatggacatgggtttcgacgcggcagctccggccccagagcaccagccgggtgcccgggcgtccgactgtggtgcgggacctatcggatttgctggcacggtgcgcaaagaggcggtcgtgaaagcggcggggttgaccacgctggccggtgacgacttcggcggcggcccaacgatgccgatgatgcccggcacctggacccatgatcagggcgtgttcgacgagcatcgctga

SEQ ID NO: 207 - DNA, 1386 bp, Mycobacterium Tuberculosis
atggccaccgccaccacccagcggcccctgaagggaccggccaagcggatgagcacctggacgatgacccgggaagccatcaccatcggattcgacgccggcgacggcttcctgggccggctacgcggcagcgacatcacccgatttcgttgtgctggcagacgttttgtctcgatcagtcaccccgactacgtcgaccatgtgctgcacgaggcccgcctgaaatatgtcaaatccgacgaatacggaccgatccgggccaccgccggtcttaacttgctcaccgacgagggcgactcatgggcaagacatcgcggcgcgttaaactcgaccttcgcccggcgccacctgcgcggactcgtcggtctgatgatcgacccaatcgccgacgtcaccgccgcgcgggtgcccggcgcgcagttcgacatgcaccaaagcatggtcgagacgacattgcgggtagtcgccaacgccctgttcagccaggacttcgggccgttggtgcagtccatgcacgatcttgcgactcgcggcctgcggcgggcggaaaagctggagcggctggggctgtgggggctgatgccgcggacggtttacgacacgctgatctggtgtatctactcgggtgttcatctgccgccgccgttgcgggaaatgcaagagatcacgctgaccctggatcgcgccatcaactcggtgatcgatcggcgactggccgagccgactaactccgcggacctgctcaacgtgttgctgagcgccgacggcggaatctggccccgccagcgagtacgcgatgaagctctgacgttcatgctcgccggccacgaaaccaccgccaacgccatgtcctggttctggtatctgatggcgctgaacccgcaggcccgcgaccacatgctcaccgagctggacgacgtgctgggcatgcgccgcccgaccgccgacgacctgggcaagctggcctggaccaccgcgtgcctgcaggaatcgcaacgctacttctcgtcggtgtggataatcgcgcgcgaggccgtcgatgatgacatcatcgacggacaccgaattcgccgcggcaccaccgtcgtcatcccgattcaccacattcaccacgacccgcgctggtggcccgacccggatagattcgatcctggccggtttttgcggtgccccacggaccgtcctcgctgcgcatacctgccgttcggtggcggccgacgcatctgcatcggacagagcttcgccctgatggagatggttttgatggcggcaatcatgagtcaacacttcacctttgacctcgcccctggctatcacgtcgaactcgaggcgacgctgaccctgcgacccaagcacggagtacacgtcatcgggaggaggcgatga

SEQ ID NO: 208 - DNA, 516 bp, Mycobacterium Tuberculosis
gtggccaccatcggggaagtcgaggtattcgtcgaccacggcgccgacgacgtattcatcacctacccattgtggatcggcacacgccaagccgaccggctccgtcagctggctgaccgcgctcgcatcgctgtcggtgcgggcaccgccgagggcgcttcgaacaccggcgcacggctcgcagacgccgctggcgcgatcgatgttctcatcgaaatcgacagtggccatcaccgcagcggcgtccgtgccgaacaagtgttggaggtcgcccacgccgtcggtgaggctgggcttcacctggtgggggtgttcaccttccccggtcacagttatgcgccaggtaaacccggcgaagccggcgagcaagagcggcgcgctctcaacgacgcggcgaacgcgctggtcgcggtgggcttcccgatcagctgccgcagcggtgggtccactcccaccgcattgctcaccgccgcggacggggcctccgagacgtcccggcgtctatgtgctcggtga

SEQ ID NO: 209 - DNA, 762 bp, Mycobacterium Tuberculosis
atgaccgtagtccccggcgcgccgtcgaggccagcttctgcggtctcgcgaccaagttatcgtcaatgtgtgcaagcttcggcccaaacatcggcgaggcggtatagcttcccgtcgtaccggcgaccgccagccgagaagctcgttttcccagtgttgctggggattctcacgctgctgctgagtgcgtgccagaccgcttccgcttcgggttacaacgagccgcggggctacgatcgtgcgacgctgaagttggtgttctccatggacttggggatgtgcctgaaccggttcacctacgactccaagctggcgccgtctcgtccgcaggtcgttgcttgcgatagccgggaggcccggatccgcaatgacggattccatgccaacgctccgagttgcatgcggatcgactacgaattgatcacccagaaccatcgggcgtattactgcctgaagtacctggtgcgggtcggatactgctatccggcggtgacgacccccggcaagccgccatccgtgctgctgtacgcgccgtcggcgtgcgacgaatcgctgccttcaccgcgggtagccaccgcgcttgtgcctggaacacgttctgcaaaccgggagttcagccgattcgtcgtcaccgagatcaagagcctcggtgccggagggcgctgcgattccgcgtcagtctctctgcagccgcccgaggaaatcgaagggccagcaatacccccggcaagcagccaattggtgtgcgtggcaccgaagtaa

SEQ ID NO: 210 - DNA, 1269 bp, Mycobacterium Tuberculosis
gtggctgaagctggtggcgggcccatttcggtgatcgcccggcatatgcagttgattcgcgatgacttcatctccgagttgtttgacaagatgaaggcggagattcgggggctggattacgacgcgcggatggcggacctgtggcgggcgagcatcaccgagaatttcgtgacggccgttcactatttggatcgcgatacgccgcagtccttggtggaggctccagcggccgcgctggcatacgcccgcgccgcggcgcagcgtgatattccgttgtccgggttggttcgggcgcaccggctcgggcatgcgcgtttcttggaggtggcgatgcagtacgtgtcgctgctggagcccgctgaccgggtgtcgacgatcatcgagctggtgaatcgctccgctcgcctcgttgacctggtggccgaccagttgattgtcgcctatgagcacgaacacgatcgctggctgagtcgccgcagcggtctgcaacagcaatgggtcagcgagctgctcgccgataccccggtcgacgttccgcgggccgagcgcgcgttgggctatcggttggacggtgtgcatatcgccgcggtggtatgggtcgattcggcggtgcccatcggtgatgtggtggcgcaattcgaccaggtgcgctgcttgctggccggggagctgggccccgaactgggccccgtggcgaactcgctgatggtgccgaccgatgagcgcgaggcacggctgtggttttcgcccgcgcccacgcgggccttcgccccgtcgcggattcgcgcggcgttcgagtcggcgggaatccgggcgcgtttggcgtgcggtcgggtaggggacgggctgcgtgggttccgggcgtcgttgaaacaggccgaacgagtgaaggcgttggccctggccggtggcgcccggcccggcggccgggtcatgttttatgacgatgtcgcgccagtcgcgttgctggccgacgatctagaggaactgcggcggttcgtcaccgatgtgctgggtgacctgagtgttgacgacgagcgcaatagctggctacgcgagacgttacgggagttcttgctgcgtaaccgcagctacgtcgccacggccgacgcgatgatcctgcaccgcaacaccattcaataccgggtgatccaggcgatggaactatgcggacagaatctcgacgatcccgatgccgcgtttcgggtgcagatggcgctggaggtctgccgctggatggcaccggcggtgctccgcgccaaacaatag

SEQ ID NO: 211 - DNA, 1239 bp, Mycobacterium Tuberculosis
atgagcgttgcaaacctcaaggatctactcgccgaaggtgtttcggggcgtggagtgctggtgcgctccgatctcaacgttccgctcgacgaggacggcaccattaccgatgcgggccgcatcatcgcgtcggcgccgacgttgaaggcgttgctcgacgccgacgccaaggtggtggttgccgcgcacttgggacgtcccaaggacgggccggacccgacactgtcgctggcgccggtcgccgtggcgctgggtgagcaactcggccggcacgtccagctggctggagacgttgtcggcgccgatgcgctggcccgcgccgaggggctcaccggcggcgacatcctgctgctggagaacatccgcttcgacaaacgcgaaaccagcaagaacgatgacgaccggcgggcactggccaagcagctggtcgaactggtcggaacgggaggcgttttcgtctccgacggctttggggtggtgcaccgcaagcaagcctcggtctatgacatcgcaaccctgttgccgcactacgccggcacgctggtcgccgacgagatgcgggtactggagcagttgaccagctcgacccagcggccctatgcggtagtgctcggcggatcaaaggtgtccgacaagctgggtgtcatcgagtcgctggcgaccaaggcggacagcattgtgattggcggcggaatgtgcttcacattccttgctgcacagggattttcggttggcacatcgctgctggaagacgacatgatcgaagtctgtcgcgggctgctggaaacctatcacgacgtgttgcggctgcccgtggatctagtggtcacggagaagttcgccgccgactcgccgccccagacggtcgacgtcggcgctgtgcccaatggcttgatgggcctggatatcgggccgggatcgatcaaacggttcagcacgctgctgtccaacgccgggaccatcttctggaacgggccgatgggagtattcgagttcccggcttatgcggccggcaccagaggcgtcgccgaggcgatcgtcgccgccaccggcaaaggggcgtttagtgtggtcggcggcggtgactccgcggccgcagtgcgcgcgatgaacatccccgagggcgccttctcacacatatccaccggcggcggtgcctcgctggaataccttgagggcaagacgcttcccggcatcgaggtactgagccgtgagcagccaaccggaggagttttgtga

SEQ ID NO: 212 - DNA, 486 bp, Mycobacterium Tuberculosis
gtggtcggatacgctgaaccggtgctcattgaacggcaaagcgtcgtcgccgcacctgccgagcaggtgtggcaacgggtcgtcaccccggagggcatcaacgatgagttgcgcccctggatgacgatgtcggtgcctcgcggcgcgaaagggatgaccgtcgacacggtgccgatcggcgcgccgatcggacgtgcctggctgcgactgttcggtgtgttgccattcgactatgaccggctcagcatcgccgagctcgagccgggacggcggtttcgcgaggattcgacgatgctgagcatgcggcaatggcagcacgaacgcaccgtgacgcccgagggtgacacgaaaacgattgtccgcgaccgcatcacgttccagacgcgtgccggactcaggtttgccgcgccgctcatcgcggcagggttgcgcgcgctcttcggtcatcggcaccggcggttgcagcgacacttcgctcagggctag

SEQ ID NO: 213 - DNA, 1122 bp, Mycobacterium Tuberculosis
atgaccgctcagaaccccaacctggccgcattgagcgccgcgggggtatcggtgtggctggatgacctgtcgcgggaccggctgcgctcgggcaatctgcaggagctgatcgacaccaagagcgtcgtcggggtgaccaccaacccgtcgatctttcagaaggcgctgtcggagggccacacctacgacgcccagatcgccgagctggccgcgcgcggcgccgacgtggatgccaccatccgcaccgtcaccactgacgacgtgcgcagcgcgtgcgacgtgctggtcccccagtgggaggactccgacggggtcgacggccgggtgtcgatcgaggtcgacccgcggctggcacacgaaaccgaaaaaacgatccaacaggcaatcgagctgtggaagatcgtcgaccggccgaaccttttcatcaagatcccggccactaaggccggtctgcccgccatcagtgccgttctggcggaagggatttcggtcaacgttacgctgatcttctccgtgcagcggtaccgcgaggtgatggacgcctacctgaccgggatggaaaaggcccggcaagccggacacagcctgtccaagatccattcggtggcatcgtttttcgtctcccgggtggacaccgaaatcgacaagcggctggacagaatcggctcgcggcaagcgctcgaactgcgcggccaggccggtgtcgccaatgcccgcctggcctatgccacctaccgggaggtcttcgaagacagcgatcgttatcggtccctcaaggtcgacggcgcccgggtccagcgcccgttgtgggcttccaccggcgtgaagaaccccgattactcggacaccctctacgtcaccgagttggtcgccccacacaccgtgaacactatgccggaaaagacaattgacgccgtcgctgatcatggcgtgatccaaggcgacacggtcaccggaactgcatccgatgcccaggcggtgttcgaccagctgggggcgatcggcatcgacctcaccgacgtgtttgccgtcctcgaggaggaaggcgtgcggaagttcgaggcctcctggaacgagctactccaggaaacccgggcgcatctcgacaccgctgcccaatga

SEQ ID NO: 214 - DNA, 2103 bp, Mycobacterium Tuberculosis
gtgaccacactcgaagagatctccgcgcttacccgaccgcgccatcccgactactggaccgagatcgattcggctgccgtcgacaccatccgggtattggccgccgatgccgtccaaaaggtcggcaacggtcatcctggaacggcgatgagcctggctccgttggcctacacgctgtttcagcggacaatgcgtcacgatcccagcgacacacactggctgggccgcgatcggttcgttttgtcggccgggcacagcagcctgaccctctacatccagctctacctcggcggcttcggcctggaactgtccgacattgagtcgttgcgcacctggggatccaagacccccggacacccggagttccgccacacccccggcgttgagatcaccaccggcccgctggggcagggactggcgtcggcggtcgggatggcgatggcctcgcgctacgagcgcggcctgttcgacccggacgccgaaccgggcgccagccccttcgaccactacatctatgtcatcgcctccgacggtgacatcgaagaaggggtgacctcggaggcgtcgtcgctggccgcggtccagcaactgggcaacctcatcgtgttctacgaccgcaaccagatctcgatcgaggacgacaccaacatcgcgctgtgtgaggacaccgcggcccgctaccgcgcgtacggctggcacgtgcaagaggttgagggcggtgagaacgtcgtcggcatcgaggaggccatcgccaatgcgcaggcggtcaccgaccggccctcgttcatcgcgctgcgcaccgtcatcggctatccggcgccgaacctgatggacaccggcaaggcgcacggcgcggcgctgggcgacgacgaggtggccgcagtcaagaagatcgtcggcttcgatccggacaagacgttccaggtccgcgaggacgtcctcacccacacccgagggctggtggcccgcggcaaacaggcccacgaacgctggcagctcgaattcgatgcctgggcgcggcgtgaacccgagcgcaaggcgctgctggaccggctgctcgcgcagaagttgcccgacggctgggacgccgacttgccccactgggaaccggggtccaaggcgctggccacccgtgcggcctcgggtgcggtgctgtccgcgctcgggccgaaactgcccgagttgtggggcggttcggccgacctggcgggcagcaacaacacaacgataaagggcgccgactcctttggcccgccctcgatttccaccaaggagtacaccgcgcactggtatggtcgcaccttgcacttcggtgttcgcgagcacgcgatgggtgccatcctgtccggcatcgtgctgcacggacccacccgggcttacggcggcaccttcctgcagttctccgactacatgcgcccggcggtgcggctggcggcgttgatggacatcgacaccatctacgtctggacgcacgactcgatcggcctcggcgaagacgggcccacccatcaaccgatcgagcacctctcggcgctgcgcgcgatcccccggctgtcggtggtgcgcccggcagatgccaacgagacagcctacgcctggcgcacgatcctggcccgccgcaacggcagcgggccggtcgggttgatcctgacccgccagggtgtgccggtgctggacggcaccgacgccgagggggttgcccgcggcggttacgtgctgagtgacgccggtggtctgcaaccgggcgaggaacccgacgtcattctcatcgccaccggctcggaggtgcagctggcggtcgcggcgcagacgttgctggcggacaacgacatcctcgctcgggtggtgtcgatgccgtgcctggagtggttcgaggcccaaccctacgagtaccgcgacgcggtgctgcccccgacggtgtcggcgcgggtggccgtcgaagccggcgtcgcgcaatgctggcaccagctggttggcgacacgggcgagatcgtctcgatcgagcactacggcgaatccgcggaccacaagaccttgttccgcgagtacggcttcactgccgaggccgtggccgccgccgccgaacgagcgctggataactga

SEQ ID NO: 215 - DNA, 3990 bp, Mycobacterium Tuberculosis
atgtcgttggtgatcgtggccccggagacggtggcggccgcagccttagatgtggcgcgcatcgggtcatcgatcggcgcggccaatgcggcggcggcggggtcgaccaccagcgtgctggccgcgggcgccgatgaggtgtcggcggcgatcgcgacgctgtttggcagccatgctcgggagtatcaggcgatcagcacgcaggtggcggcgtttcatgaccgatttgcgcagacgttaagcgccgcggtcggctcgtatgtcagcgcggaggcgaccaacgccgcaccgttggcgacgctggagcacaacgtgctcaatgccctcaatgcgcccacccaggcgttgctgggtcgcccgttgatcggtgatggggcggctggagcacccggcaccgggcaggccggcggggccggcgggatcttgtggggcaacggtggggccggcggctcgggcgcgcccggccaagtcggcggggccggcggggccgccgggttgttcggcaccggcggggccggtggggccggtggggccggcgccgccggtggggccgggggtagcggcggctggctgctgggcaatggtggagtcggcggggccggcgggcagagcctgctgggcggggcaaccggcggggccggcggcaacgccggactgttcggggtcggcggaaccggcgggcccggcgggcccggcgggcccggcggggtcggcggtaccggtggtgccggtggcctgggcgggaccctctacggggccggcgggcacggaggtgccggcgggcccggcccgatcggtggtgtgggtggacacggcggtgtcgggggtgcggccgggctgttgggcgtgggcgggcacggtggtgccggcggacacggcgcggagggtgtggccggcgcagccggtgaggacttgtccccgcacggtacgtccggtggggtcggcggcgacgccggcgatggcggcaccggagggcggggcggctggctggccggcgccggtggggccggcggggccggtggggttggcgggaccggcggggccggcggggccggattttctcgtgccttgattgtcgctggggataacggcggtgaccccggcgccggcggggccggaggcaccggcggagccggctccacgatcggtgcccacggcgcggccggggccagccccaccagcggcggcaacggcggggccggcggcaacggcgcccacttctcatcgggcggcaaagccggcggtaacggcggggccggcggggccggcgggctggtcggcaatggcggcgccggaggtgccggcggcaacggcgcccccggtgccccgccttctggcggcgaccctaacggcggtggcggcggagctggcggcgctggcggtaagggcggcgacggcggagcccaagcaggcgacggcggtgctggcggcgccggcggtaagggcggcaacggcggcaacggcgccaccggcgccaccggccttaacggcctgggggcaggcgcggatggcaccgacggcggcaagggcggcaacggtggagccggcggtggcggtggagccggtgggcaaggcggtaaggcgcttgcagccacccaccaggacggcagcatgggtgccggcggggccggcggaaacggcggcgccggcggcatgggcggtgatggcggcaacggtgccaagggcacgttcgataacggcggcgatggagttggtggcaacggcggcaacggcggtagccgcggcatcggtggtgctggtgggatcggcggcgccggatccaccgcgggtgcagacggtgcccgcggcgccaccccgaccagcggcggcaacggcggcaccggcggcaacggcgcgaacgccaccgtcgccggcggggccggcggggccggcggcaagggcggcaacggcgggcttgttggtaatggcggggccggcggcaaaggcggggacggcatggccggtgtcgccggttcctcgcccaccaccgcgggcgaatccggcacgagcggccagaacggcggggctggcggggcgggcggggccggcggccggggcggagacttcgggggcgacggcgggaccggtggggccggcggcaacggcgccaacggcgccaacgccaccacgccgggcgccaagggcggcgacggcggccacggcgggcccggcgcgcaaggcggtaacggcggccaaggcgggcccggcggtttggcggggaacctctttggccagaacggaatccagggtgtcggcgggtccggcggcaaagggggggccggcgggctcgccggtgacggcggcaacggcgccaacggcaacttcgccttcggcgatggtaacggcggtcacggcggtaacggcggtaaccccggcgccggcgggcagggcggtagcggtggcgccggctctaccccaggcgccaagggcgcccacggcttcactccaaccagcggcggcgacggcggcgacggcggcaacggcggcaactcccaagtggtcggcggcaacggcggcgacggcggcaatggcggcaacggcggcagcgccggcacgggcggcaacggcggccgcggcggcgacggcgcgtttggtggcatgagtgccaacgccaccaaccctggtgaaaacgggccaaacggtaaccccggcggcaacggtggcgccggcggggccggcggggccggcctgaacggcggtaacggtggcgccggcggcaacggcggcctcggcggattcggcggcaacggcgccgccggtgccaacggcgtggccgtgggtgcgcccggacaacccggcggtgccggcgggcacggcggcgccggcggcaacggcggggccggcggcaacggcggtcaaggcgtagtcagcgacggcgcgggcggtgccggtggggccggcggcgacggcggtgctcccggtgacggggccaacggcggcaacggccagggagcaggggccttcgccggcggcggcggcgggcgaggcggcgacggcggcaacgccggcaacgccggtgccggcggccccggcggcaccggctccaccgcaggcaaggcggggccggccggcagcatcctgcacgacggcggcaacggcggtcacggcggccacggcgctgccagcggcggaaacggcggccccggcggccacgggggtaacggcggtaacggcggcaccggcgccaacggcggcaacggtggcatcggcgggactggcggcgccggcagcaccggcgccaagggcgtcctcggcaccaacgagggcgatggcggtgacggcggcagaggcggcaacggcggcagaggcggcaacggcggccaaggcctcaccggagccggcggcaacggtgggaccggcgggacacccggcaacggcggcaacggtggcaacggcgccagtggcgaccttgtcacctcacctggtgacggcggcggcgggggccgcggaggcgatgcaggacgcggaggcgatgcaggacttggcggttccagcggcccaggtggcacccccggcgactggggcaccggcggcaccggcggcaccggcggcaccggcggccagggtgccaacggcggcctcaccggcggcagaggcggcactggcggcaacggcggcaacggtaacaccggcggcaccggcggcgctggcggcaccggcggcaccggccacaacggctctcagcctgggatgggtggcaacggaggtgcgggcggctttggcggcaatggttttgccggcgtcggtggccggggcgggatgggtggctccgggggcaccggcggcaccggcgacgcggggccctttggaacaggcaccggtgggaccggtggccacggggggcagggcggtggcggcggcttcagcatcctccttggtctcggcggtctcggcggcctcggtagcccggggtccatcgccacaggtaccgccggcggcgccggtggcggcggtggcttcggcgggctcggcggcggcgaattcgtgtag

SEQ ID NO: 216 - DNA, 2226 bp, Mycobacterium Tuberculosis
atgtcgttggtgatcgtaaccccggagacggtggccgcggcggcctcggatgtggcgcgcatcgggtcatcgatcggtgtagccaacagcgcggcggcggggtcaaccaccagcgtgctggccgcgggcgccgatgaggtgtcggcggcgatcgcgacgctgtttggcagccatgctcgggagtatcaggcgatcagcacgcaggtggcagcgtttcatgaccgatttgcgcagacgttaagcgccgcggtcggctcgtatgtcagcgcggaggcgaccaacgccgcaccgttggcgacgctggagcacaacgtgctcaatgccctcaatgcgcccacccaggcgttgctgggtcgcccgttgatcggtgatggggcggctggagcacccggcaccgggcaggccggcggggccggcgggatcttgtggggcaacggtggggccggcggctcgggcgcgcccggccaagtcggcggggccggcggggccgccgggttgttcggcaccggcggggccggtggggccggtggggccggcgccgccggtggggccgggggtagcggcggctggctgctgggcaatggtggagtcggcggggccggcgggcagagcctgctgggcggggcaaccggcggggccggcggcaacgccggactgttcggggtcggcggaaccggcgggcccggcgggcccggcgggcccggcggggtcggcggtaccggtggtgccggtggcctgggcgggaccctctacggggccggcgggcacggaggtgccggcgggcccggcccgatcggtggtgtgggtggacacggcggtgtcgggggtgcggccgggctgttgggcgtgggcgggcacggtggtgccggcggacacggcgcggagggtgtggccggcgcagccggtgaggacttgtccccgcacggtacgtccggtggggtcggcggcgacgccggcgatggcggcaccggagggcggggcggctggctggccggcgccggtggggccggcggggccggtggggttggcgggaccggcggggccggcggggccggattttctcgtgccttgattgtcgctggggataacggcggtgatggtggtaacggcgggatgggcggggctggcggggctggcggccccggcggggccggcggcctgatcagcctgctgggcggccaaggcgccggcggggccggcgggaccggcggcgctggtggcgtcggcggtgaccgcggagccggcggccccggcaaccaggccttcaacgcaggtgccggcggggccggcggccatggcggtgaccccggcgccggcggggccggaggcaccggcggagccggctccatcaccggcgctcagggcgccatcggcgccacccccaccagcggcggcaacggcggggccggcggcaacggcgccaacgccaccaccgcgggcaccaacggcgccaacggcggacccggcggccatggcgggctggtcggcaacggcggcgccggcggcaacggcgccaacggcgccgcagggacgaacgcgagcgattcgggcgcagtcggtggcaaaggcaatagcggcggcaacggcggccagggcggcgccggcggcgacggcggaactctcgccggcaatggcggggccggtgggactggcggccgcggcgcagacggcgggctcggtggtagtggtgccgagggtgccaatgccaccaccgcgggcgagcgtggccaggacggtggtaaaggcggcaacggtggggtcggcgggaccggcggcaacgccgtcgcacccggtgccaacggcggccatggcggcaacggcggcaatcctggcttcagcggcgctggcgggctcggggggctcagcggtgacggcgtgacccgcgccgcgcagggtgcgacccccgactttgcagacaccgggggcaaaggcggcaacggcggtaacggcgccaacgccgttgcacccggcggcaccggcgccagtggcggagccggcgggaacgctggggctggcggcaagggcggggaaaacatcatcggcgatggcggcggcggaaacggcggggccggcggcaagggcggcgccggcaccctgctaggtctcacggtatttggcgacaatggcggcgccggcgtcctcggcgactcgacggacccagatggcagcggcggtgctggtggcgcgggcggcgccggtggcgccggtggcgatccaaccatctga

SEQ ID NO: 217 - DNA, 192 bp, Mycobacterium Tuberculosis
atgcggaagtcaaagaagacgcgcgatcagctgctgcgcgagttgcgcaacgcctacgagggcggggccagtatccgcaacctggcggccaccaccggccggtcgtacggatctattcacagcatgctgcgcgagtcaggcaccacgatgcgcggccgcggcggccccaatcgccgttcccggccgcgttga

SEQ ID NO: 218 - DNA, 561 bp, Mycobacterium Tuberculosis
atgaccgggccatattttcctcagacgatcccgttcctgcccagctacattccgcaagacgtcgacatgaccgcggtcaaagcggaggtcgccgcactcggtgtcagcgctccaccggcggccacgccgggcctgctcgaggtggtccagcacgctcgcgacgagggcatcgatctcaagatcgtgctgctcgaccacaacccgcccaatgacacaccgctgcgtgacatcgcgaccgttgtcggggccgactactcggatgccaccgtcttggtgctcagcccgaactatgtcggcagttacagcacgcaatacccccgggtcacgctcgaggccggggaagaccattccaagaccggcaatccggtgcagtccgcgcagaactttgtccatgagctgagcacacccgagtttccctggagcgcgctgaccattgttttgctgatcggtgtgctggcagcggctgtgggtgctcggttgatgcaactgcgcgggaggaggtcagcaacgtcgactgacgccgccccaggggcgggggacgatctcaatcaaggcgtctag

SEQ ID NO: 219 - DNA, 744 bp, Mycobacterium Tuberculosis
gtgactgccacagccactgaaggggccaaacccccattcgtatcccgttcagtcctggttaccggaggaaaccgggggatcgggctggcgatcgcacagcggctggctgccgacggccacaaggtggccgtcacccaccgtggatccggagcgccaaaggggctgtttggcgtcgaatgtgacgtcaccgacagcgacgccgtcgatcgcgccttcacggcggtagaagagcaccagggtccggtcgaggtgctggtgtccaacgccggcctatccgcggacgcattcctcatgcggatgaccgaggaaaagttcgagaaggtcatcaacgccaacctcaccggggcgttccgggtggctcaacgggcatcgcgcagcatgcagcgcaacaaattcggtcgaatgatattcataggttcggtctccggcagctggggcatcggcaaccaggccaactacgcagcctccaaggccggagtgattggcatggcccgctcgatcgcccgcgagctgtcgaaggcaaacgtgaccgcgaatgtggtggccccgggctacatcgacaccgatatgacccgcgcgctggatgagcggattcagcagggggcgctgcaatttatcccagcgaagcgggtcggcacccccgccgaggtcgccggggtggtcagcttcctggcttccgaggatgcgagctatatctccggtgcggtcatcccggtcgacggcggcatgggtatgggccactga

SEQ ID NO: 220 - DNA, 6327 bp, Mycobacterium Tuberculosis
gtgggtaaggagagaacaaagaccgtggataggacacgtgttacgccggtagctgtcattggtatggggtgccggctgccggggggcatcgactcacccgatcggttgtgggaggcgttgctgcggggcgacgatctggtcaccgagatccccgccgaccgctgggacatcgacgagtactacgaccccgaacccggcgtgcccggacgcaccgactgcaaatggggcgcgtacctcgataacgtcggcgactttgatcccgagttcttcgggatcggggagaaagaagcgatagcgatcgatccgcagcaccgcttgttgctggaaacctcctgggaagccatggagcacggcggcctaacaccgaaccagatggcctcgcggacaggggttttcgtggggttggttcataccgactacatattggtacacgccgacaaccagactttcgaagggccgtacggcaacacgggcaccaatgcctgcttcgcatccgggcgggtggcgtacgccatgggcttgcagggtcccgcgatcacggtagataccgcatgctcgtctggcctcaccgctatccacctggcttgtcgtagcctgcacgacggcgaaagcgacattgcgctagccggcggtgtctacgtgatgctcgaaccgcggcggttcgcctcgggctcggcgttgggcatgttgtctgcgaccgggcgctgtcatgcgttcgacgtttccgcggacggtttcgtctccggtgagggttgtgtcatgttggcgctcaagcggttgccggatgcgctggccgatggggaccggatcctggccgtaattcgtggcacggccgccaaccaagacggccacaccgtcaatatcgcgacaccatcacggtccgcgcaggtcgcggcgtatcgggaggcgttggatgtggccggtgtggacccggctacggtgggcatggtcgaggcgcacggcccgggcaccccggtgggtgaccccatcgaatacgccagcctggccgaggtatacggcaacgacggcccctgcgcgctggcatcggtgaagaccaatttcggccacacccagtcggccgctggagcgctgggactgatgaaggcggtcctggccctccaacacggcgtggtcccacagaatctgcacttcacggccctgcctgacaagcttgccgcaatcgaaaccaacctgtttgtgccgcaagagattacgccgtggcccggcgccgatcaagaaacgccccggcgcgcggcggtgtcgtcgtatggcatgacgggcaccaatgtgcacgccattgtcgagcaggcaccggtgccagcccccgaatccggtgcaccaggcgacaccccggccacacccggtatcgacggcgcgctgctgttcgcgctgtcggccagctcgcaggacgcgctgcggcagaccgccgcgcggctggccgattgggtcgacgcccaaggacccgagctggcgccggcggatctggcctacaccctggcccgccggcgcggacaccggccggtgcgcaccgccgtactggccgccaccaccgcggagctgaccgaggcgctgcgggaagtcgccaccggcgaacccccctacccacccgcggtcggccaagacgaccgcggaccggtctgggtgttctccgggcaaggctcgcaatgggcgggcatgggcgccgacctgctggccaccgaaccggtattcgccgccaccatcgccgcgatcgaaccactgatcgccgcggaatccggcttctcggtgaccgaagccatgaccgcccccgaggtcgtgaccggcatcgaccgggtgcaaccgaccctgtttgccatgcaggtcgcgctggcggccacaatgaagtcctacggcgtagcgcccggcgcggtcatcggccactcgctgggcgagtccgcggccgcggtggtcgccggcgcgctctgcctcgaagacggagtgcgcgtcatctgccggcggtcggcgctgatgacccgtatcgccggcgccggcgccatggcatcggtggaactgcctgctcaacaagtgctttcggagttgatggcgcgcggcgtcaacgacgccgtggtcgcggtggtggcctccccgcagtccaccgtgatcggcggggccacccagacggtacgcgacctggtggccgcctgggagcaacgcgacgtgctggcccgtgaggtggccgtcgacgtagcatcgcactccccgcaggtcgacccgatcctcgacgaactggccgaagcgctcgccgaaatcagcccgctgcaaccggaaatcccctactactcggcgacctcgttcgacccgcgcgaggagccctactgcgacgcctactactgggtggacaacctgcgccacaccgtacgcttcgccgcggcggtgcaagccgccctcgaagacggctaccgggtcttcaccgagctgaccccccaccccctgctgacccacgcggtcgaccagaccgcccgcagcctcgacatgtccgcggctgcgctggccggcatgcgccgcgaacaaccactgccccacgggctgcgcgcactggccggcgacctctacgccgccggcgccgccgtcgacttcgccgtgctctaccccaccggccgactgatcaacgcaccactgcccacatggaaccaccgtcgtctgctgctcgacgacacgacccgtcgcatcgcccacgccaataccgtcgccgtacacccattgctgggctcccacgtgcgcctgcccgaggagccggaacgccacgtctggcagggcgaggtcggcaccgtgacacaaccctggctggccgatcaccaaatccacggcgcggccgcccttccgggagccgcctactgcgagatggcgttggccgcagcccgcgccgtcctcggcgaagcctccgaagtccgcgacatccgattcgagcagatgttgctgctcgacgacgaaacccccatcggcgtcaccgccacggtagaagcccccggcgttgtcccactcacagtagagaccagccatgatggtaggtacacacggcaactcgccgcggttctgcacgttgtccgggaagccgacgacgccccggaccagccaccccagaaaaacatcgccgaactgctggccagccatccccacaaggtggacggcgccgaggttcggcaatggctggacaagcgtggtcatcgcttagggccggcttttgcgggtctggttgacgcgtacatcgccgaaggggccggcgacacggtgctggccgaggtcaacctaccgggcccgcttcgctcgcaggtcaaagcttacggcgtgcatcccgtgctgctggatgcgtgcttccagtcggtggcggctcatcccgccgtccagggtatggccgacggtggtttgttgctgccgttgggtgtgcggcggttgcggtcctatgggtcggcccgtcatgcccggtactgctgcacgacggtgaccgcgtgcggtgtgggcgtggaagccgacctggacgtgttggacgagcacggcgcggtggtgttggcggtgcgtgggctgcagttgggtaccggcgcgtcgcaggccagcgaacgtgcccgggttttgggtgagcggctgctgagcatcgaatggcacgaacgtgagctgcccgaaaacagccacgccgaacccggcgcctggctgctgatcagcacgtgtgacgctacggatttggtggccgcacagttgaccgacgcgctgaaggtgcacgacgcgcagtgcacaacgatgtcctggccgcagcgcgccgaccacgcagcccaggccgcgcggctgcgcgaccagctcggcaccggcgggttcaccggcgtattcgtgttgaccgcgccgcagaccggcgaccccgacgcggaatcccccgtgcgcggcggcgagcttgtcaaacatgtggtgcgtatcgcccgcgagattccagagatcacggcccaagagccgcggttgtatgtgctgacccacaatgctcaggcggtgttgtctggtgaccgacccaatcttgagcagggtgggatgcgggggttgttgcgggtgattggtgctgagcatccgcatttgaaggccagctatgtcgatgtggatgagcagaccggcgcggagtcggtggcgcgtcagctgctggcggccagcggcgaggatgagaccgcctggcgcaacgaccagtggtacaccgcccggttgtgcccagccccgctgcgccccgaggagcggcaaaccaccgtcgtcgaccacgccgaggccggcatgcgcctacagatccgtactcccggtgacctgcaaaccttggagttcgccgcgttcgaccgggtcccgccgggcccgggagagatcgaggtcgccgtcaccgcgtccagcatcaacttcgccgacgtgctggtcaccttcggccgctaccaaaccctcgacgggcgacagccgcagctgggcaccgatttcgccggggtggtgagcgcggtcgggcccggggtcagcgaactcaaggtcggtgaccgggtcggcggcatgtcacccaacggctgctgggccacgttcgtcacctgcgacgcccgcctggccaccagactgcccgaggggctgaccgacgcccaagccgcggcagtgaccaccgccagcgccaccgcgtggtacgggctgcaggacctggcgcggatcaaggccggcgacaaggtgctcatccactccgccaccggcggagtgggccaggccgcaatcgcgatcgcgcgtgcggccggagcccagatctacgccaccgcaggcaacgaaaagcgtcgagacctgctgcgcgacatgggcatcgaacacgtctatgactcgcgcagcgtcgagttcgccgagcagatccgccgcgacaccgccggctacggcgtggacatcgtgctcaactccgtgaccggtgccgcacagttggccggcctcaaactactggccctgggcggccgcttcatcgaaatcggcaaacgcgacatctactccaatacccgactggaactcttgccattccggcgcaatctggcgttctacggtctagacctggggttgatgtcggtgagccatccggctgcggtccgcgaactgttgagcacggtgtatcggttgaccgtcgagggtgtgctgccgatgccgcagagcacccattacccgctggccgaggcggccaccgcgatccgggtgatgggcgcggccgagcacaccggcaagctcatcctcgacgtcccccacgccgggcgcagcagcgtggtgcttccccccgaacaggctcgggttttccgttcagacgggtcctacatcatcaccggtggcctgggtgggctgggcttattcctggccgagaagatggccaacgccggggccggccgcatcgtgctcagctcgcgctcacagcccagccaaaaggcgttggagaccatcgaactcgtccgcgcgatcgggtctgacgtagtggtggagtgcggcgatatcgcccagccggacaccgccgaccggttggtcacggcggccaccgcgacgggtttgccgctgcgcggcgtgctgcacgcggccgcggtggtcgaggacgccaccttggccaacatcaccgacgaactcatcgaacgcgactgggcgcccaaggcatatggcgcctggcaactgcaccgggccaccgcggaccagccgctggactggttctgctcattctcctcagcggccgccctggtgggctcgccgggtcagggcgcctacgccgcggccaacagctggctggacaccttcacccactggcggcgagcccaagacctaccagccacctccatcgcctggggcgcctggggccagatcggccgcgcgatcgcctttgccgaacaaaccggcgacgccatcgcccccgaggaaggcgcctacgccttcgagaccctgctgcgccacaaccgcgcctacagcggctacgccccggtgatcggatcaccctggctgacagccttcgcccagcacagcccattcgcggagaagttccaatccctggggcaaaaccgttcaggcacaagcaaattccttgccgagctggtggacctgccccgcgaggaatggccagaccggctgcggcggctactctccaagcaggtcggcctaatcctacgccgcaccatcgacaccgaccggctgctcagcgagtacggcctggactcactgagcagccaggaactgcgtgcgcgggtggaagccgaaaccgggatccgcatttccgccaccgaaatcaacaccaccgttcgtggcctggcggatctgatgtgcgacaagttggcggccgacagggacgcgccggcacccgcctga

SEQ ID NO: 221 - DNA, 1128 bp, Mycobacterium Tuberculosis
atgcggaccagagtcgccgagctgctcggtgctgagtttccaatatgcgcgttcagccactgccgggatgtggtggcggcggtgtccaatgcgggcgggttcgggatcctcggtgccgtcgcacatagccccaaacggctggagagcgagctgacctggatcgaggagcacacgggtggcaagccgtacggagtcgacgtgctgctgccgcccaaatacatcggcgccgagcaaggcggtatcgatgcccagcaggcccgggagctcatacccgaagggcatcgcaccttcgtcgacgacttgctggttcgctatggcatccccgcggtcaccgaccggcagcgttcgtcctcggccggtgggctgcacatctcgcccaagggttatcagccgttgctggatgtggccttcgcccatgacatccggttgatcgccagcgcgctcgggccgccgccaccggatctcgtggagcgcgcccacaaccatgacgtgctggttgccgccctagccggcacggcgcagcacgcgcggcgacacgcggctgcgggtgttgacctgatcgtcgcgcagggcaccgaggccggaggccacaccggcgaggtggcgaccatggttctggttcccgaagtcgtcgatgcggtgtcgccaacgccggtgctggccgcgggcgggatcgcccgtggccgccagatcgctgcggcgttggccctgggggcggaaggcgtctggtgcgggtcggtctggttgaccaccgaagaagccgaaacgcccccggtggtcaaggacaagtttctggccgcaacatcctcggacacggtgcggtcccggtcgctaaccggcaagccggcgcgcatgctgcgcacggcctggaccgacgaatgggatcggcctgacagccccgacccgcttggcatgccgctgcagagcgcgctggtcagcgacccgcagttgcgcatcaaccaggccgccggccagcccggggccaaggctcgtgagctggcgacctacttcgtcggacaggtcgtcggctcactcgaccgggtgcggtcggcccgctcggtggtgcttgacatggtcgaggagttcatcgacaccgtcgggcaactgcaggggttggtgcaaaggtga

SEQ ID NO: 222 - DNA, 3126 bp, Mycobacterium Tuberculosis
gtgaccgataacgcatatccaaagctggccggcggggcacccgacctcccggcactcgaactcgaggtcctcgactactggtcccgtgacgacaccttccgggccagcattgctcgccgcgatggcgcccccgagtatgtgttctatgacgggccgccgtttgccaacggtctgccgcattatgggcacctgctcaccggctacgtcaaagacatcgtgccgcgatatcgcactatgcgcggttacaaggtggagcgtcgcttcggctgggacactcacgggctgcccgccgaactcgaagtcgagcgccagcttggcatcactgacaaatcccagatcgaggccatgggtatcgccgccttcaacgatgcctgccgcgcatccgtgttgcgctacaccgacgagtggcaggcgtatgtaactcggcaagctcgctgggtcgacttcgacaacgattacaagacgctcgatctggcttacatggagtcggtgatttgggccttcaaacagttgtgggacaagggcctggcctacgagggctaccgggtgctgccgtactgctggcgcgacgaaactccgctgtcgaatcacgaactgcggatggacgacgacgtctaccaaagccgccaagatcccgcggtaacggtgggcttcaaggtggtgggtggccaaccagacaacgggctagacggtgcctacttgctggtgtggacgacgactccgtggaccctgccgtcgaacctcgcagttgcggtaagcccggacatcacctacgtacaggtccaggcgggcgatcgccgtttcgtactggccgaggcacggctggccgcttacgcccgcgaactcggtgaagagcccgtggtgctcggcacctatcgcggcgccgaactgctgggcacccgctacctgccgccgtttgcctatttcatggactggcccaacgcttttcaggtgctagcaggcgactttgtaacgaccgacgatggcaccggcatcgtgcatatggcaccggcctatggtgaggacgacatggtggtcgcggaggcggtcggtatcgcgccggtgactccggtcgactccaagggacgcttcgacgtcaccgttgccgattaccaagggcagcatgtctttgacgccaacgcgcagatcgtccgggacctgaagacccaaagcggcccggctgcggtgaatggcccagtgttgattcgtcacgaaacctacgagcacccttacccacactgctggcgatgccgtaacccgctgatctaccggtcggtgtcgtcgtggttcgtcagggtgacggacttccgagaccgcatggtggagctaaaccagcagatcacgtggtatcccgaacacgtcaaggacggccagttcggcaagtggctgcagggcgcccgcgattggtcgatctcccggaatcgctactggggtaccccgattccggtatggaagtccgacgacccggcctacccgcgcatcgatgtctacggcagcctcgacgagctggagcgcgacttcggcgtacgcccggccaatttgcaccggccctacatcgacgagctcacccgtcccaacccagacgatccgactggccgtagcacgatgcgacgcattcccgatgtgctcgacgtgtggttcgactcgggatccatgccgtatgcccaggtgcactacccgttcgagaacctggattggttccagggacactaccccggcgacttcatcgtcgagtacatcgggcagacccgtggctggttttacacactgcatgtgttggcgaccgcgctctttgaccggccggcattcaaaacctgtgtggcgcatgggattgtccttggtttcgatggccagaagatgagcaagtcgctgcgcaactatccagacgtaacagaggtgttcgatcgcgacggctccgacgccatgcggtggttcctgatggcatcgccgattctgcgcggcggcaacctgatcgtcactgagcaaggaattcgcgacggtgtgcgacaagtcctgctgcccctgtggaacacctacagcttcctggcgctgtatgcaccgaaagtcggtacctggcgcgtcgattcggtgcacgtgctggatcgctatatcctggccaagctggcggtgctgcgcgacgacctcagcgagtcgatggaagtttacgatattcccggtgcctgtgaacatttgcgtcagttcactgaggcgttgactaattggtatgtgcgacggtcgcgttcgcggttctgggcagaagacgccgatgccatcgacacgctacacaccgtgttggaggtgaccacgaggctggccgccccgctgcttccgctgatcaccgagataatctggcgtggtctgacacgcgagcgatcggtgcacctgacggactggccagcgcccgacctgctgccgtcggatgccgacctggtcgccgcgatggaccaggtccgcgacgtgtgctcggcggcatcctcgctgcgcaaggccaagaagctacgggtgcgcctgccgctaccgaaactcattgtggcagttgagaatccgcaacttctgaggccgttcgtcgacctcattggcgacgagcttaacgtgaagcaggtcgaactgaccgatgccatcgacacctatggccgattcgagctcacggtcaacgcccgggtagccggaccacggctgggcaaagatgtgcaggccgccatcaaggcggtcaaggccggcgacggcgtcataaacccggacggcaccttgttggcgggccccgcggtgctgacgcccgacgagtacaactcccggctggtggccgccgacccggagtccaccgcggcgttgcccgacggcgccgggctggtcgttctggatggcaccgtcactgccgaactcgaagccgagggctgggccaaagatcgcatccgcgaactgcaagagctgcgtaagtcgaccgggctggacgtttccgaccgcatccgggtggtgatgtcggtgcctgcggaacgcgaagactgggcgcgcacccatcgcgacctcattgccggagaaatcttggctaccgacttcgaattcgccgacctcgccgatggtgtggccatcggcgacggcgtgcgggtaagcatcgaaaagacctga

SEQ ID NO: 223 - DNA, 609 bp, Mycobacterium Tuberculosis
atggtaggcgctgtgacccagatagcggatcggcctacagacccctcgccctggtcgccgcgagagaccgagttactggcggtgacactacggctgctgcaggagcacggttatgaccggctaacagtggatgccgttgcggcgagcgcccgcgccagcaaggcaacggtctaccggcgctggccgtcgaaagccgaattggtgctggccgcgttcatcgagggcatccgccaggtcgcggtcccgcccaataccggcaacctgcgcgacgacttgctgcgactgggggagctgatctgtcgggaggtgggccaacacgccagcaccatccgcgcggtgctcgtcgaagtgtcgcgcaatcctgccctcaacgacgttttgcagcatcagttcgtcgaccaccgtaaggccctgatccagtacatcttgcagcaggccgtcgaccgcggtgagatctccagcgcggccatcagcgatgaactctgggacctgctacccggctacctcatcttccggtccatcatccccaaccggccgcccacccaggacacggtgcaagccctcgtcgacgacgtgatactccccagcctcacccgatccaccggttga

SEQ ID NO: 224 - DNA, 2166 bp, Mycobacterium Tuberculosis
atgtcgtcgaacaacgccggggagtccgacgggaccgggcccgctctacccacggtgtggccgggcaacgcctatccgcttggagccacctacgacggcgccgggaccaacttttcgttgttctccgagatcgccgagaaggtcgagctatgtctgatcgacgaggacggcgtcgagtcgcggatcccgcttgacgaggtggacgggtacgtctggcatgcctatctgccgaacatcacccccggccagcgctacgggtttcgtgtgcacgggccgttcgacccggcggccggccatcggtgtgaccccagcaagctgctgctcgacccgtatgggaagtcgttccacggcgatttcaccttcgggcaggcgctgtattcctatgacgtcaacgccgtcgacccggacagcactcccccgatggtcgactcgctgggccacactatgaccagcgtcgtgatcaatccgttcttcgactgggcatacgaccggtcgccgcgcaccccgtaccacgagaccgtaatctacgaagcgcatgtcaaaggcatgacacagacccatcccagtatcccgcccgaactccggggcacctacgccggcctggcccacccggtgatcatcgaccacctcaacgagctcaacgtcaccgccgttgagttgatgccggtgcaccagttcctacacgactcccggctgctggacctcggcttgcgaaactactggggttacaacaccttcggattcttcgccccgcaccatcaatacgcgtcgacccggcaagccggcagcgcggtagccgagttcaaaaccatggtgcgcagcctgcacgaagccggcatcgaggtcatcctcgacgtcgtctacaaccacaccgctgaaggcaaccacttgggtccgacgatcaactttcgcggaatcgacaacaccgcctactaccgactgatggaccacgacttgaggttctacaaggacttcaccggtaccggcaacagcctcaatgcccgccacccacacaccctgcagctgatcatggattcgctgcgctactgggtgatcgaaatgcacgtcgacgggttccggttcgacctggcgtccacgctggcccgcgagctgcacgacgtcgaccggctgtcggcattcttcgatctggtgcaacaagatccggtggtcagtcaggtcaagctgatcgccgagccatgggatgtcggcgaaggtggctaccaggttggcaacttcccaggactgtggacggaatggaacggcaagtaccgcgacaccgtgcgcgactactggcgaggcgagccggccaccctaggcgaattcgcctcccggctgaccgggtcgtcggacctctacgaagcaaccggccgccggcccagtgccagtatcaatttcgtcaccgcccacgacgggttcacactcaacgacctggtctcgtacaacgacaagcacaacgaggccaatggcgagaacaaccgcgacggggaaagctacaaccgatcgtggaactgcggtgtcgagggccccaccgatgaccccgacatcttggcgctgcgtgcccgccagatgcgcaacatgtgggccacgcttatggtcagccagggcacgccgatgatcgcccacggcgacgagattgggcgcacccaatacggcaacaacaacgtctactgccaggactccgaattatcttggatggattggtcattggtggacaagaatgccgatctgctagctttcgcacgcaaggcgacgaccttgcgcaagaaccacaaggtgtttcgccgacgccggttctttgagggtgaaccgatccgcagtggcgacgaagtccgcgatatcgcctggttgacaccgagcggtcgggagatgacgcacgaggattggggcagaggcttcgacaggtgtgttgcggtgtttctcaacggtgaagccattaccgcaccggacgcccgtggtgagcgagtagtcgacgattcattcctgttgtgcttcaacgcccatgaccacgacgtggagttcgtgatgccgcatgacggctatgcgcagcagtggaccggagagctggataccaacgatcccgtcggtgacatcgacctgacggtaaccgccactgacacgttttcggtacctgcgcgctcgctgctggtcctgcgtaagacgttgtga

SEQ ID NO: 225 - DNA, 105 bp, Mycobacterium Tuberculosis
gtggaatgttcttcagcagtccacggccaaccccgcaccaacaccttccaccaccacgagaagctgctacgccacaacgacgaggacaaccacgacgatccgtga

SEQ ID NO: 226 - DNA, 1410 bp, Mycobacterium Tuberculosis
gtgagatacactacacctgtgcgtgctgctgtctacctccgaatctcagaagaccgctccggcgaacagctcggcgtggcccgccaacgcgaggactgcctaaagctgtgcgggcagcgaaaatgggtgcccgtcgagtacctcgacaacgacgtcagcgcatcaaccggcaagcgccgccccgcctacgagcagatgttggccgacatcaccgccggcaagatcgccgccgtggtggcctgggacctggaccggctccatcgccgtcccatcgagctggaagccttcatgtcattagccgacgagaagcggctggccctggccaccgtcgccggcgacgttgacctggcgacaccccagggccggctagtcgcccgcctgaaggggtcggtggccgctcacgaaaccgagcacaagaaggcacgacagcgccgcgccgcccgccagaaagctgaacgcggccaccccaactggtcgaaagccttcggctacctgcccggccccaacggtcccgaacccgacccccggacagcgccgctggtcaaacaggcctacgccgacatcctcgccggggcgtccctgggcgacgtgtgccgccagtggaacgacgccggggcgttcaccatcaccggccgcccgtggacgactacaacgctgtcgaaattcttgcgcaaaccccgcaacgccggactacgcgcatataagggtgcccgctacggcccggtggaccgcgacgcgattgtcggcaaggcccagtggtcgccgctggtggacgaggcgacgttctgggccgcccaggccgtgctggacgcccccggccgcgcccccggccgcaaaagcgtgcgccgccacctgctgaccgggctggcaggctgcggcaaatgcggcaaccacctggccggcagctaccgcaccgacggccaggtcgtctacgtgtgcaaggcgtgccacggggtggccatcctggccgacaacatcgaaccgatcctgtatcacatcgtggccgagcggctggccatgcccgacgccgttgacttgttgcgccgggagattcacgacgccgccgaagccgaaaccatccgcctggaactggaaaccctctacggggagctggacaggctcgccgtcgaacgcgccgaagggctactgaccgcgcgccaggtgaagatcagcaccgacatcgtcaacgccaagataacgaaacttcaggcccgccaacaggatcaggaacggctccgagtgttcgacgggataccgttgggaacaccgcaagtcgccgggatgatagccgagctgtcgccggaccggttccgcgccgtcctcgacgtcctcgctgaagtcgttgtccagccggtcggcaagagcggcaggatattcaatcccgaacgggtgcaggtgaattggcgatga

SEQ ID NO: 227 - DNA, 1143 bp, Mycobacterium Tuberculosis
atgaccaggtccggacacccggttacattggacgacttgccgctgcgcgccgacttgcgtggtaaagcaccatacggtgcaccgcaattagctgttccggtacggctgaacaccaacgagaacccgcacccgcctacccgggcgctggttgacgacgtggtgcgatcggtgcgggaagcggccatcgacttgcaccgctaccccgaccgcgacgccgtggctctgcgtgctgacttggccggctatctcaccgcgcagaccggaatccagcttggtgtcgaaaacatatgggctgccaacggttccaatgagattctgcagcaactgttacaggcgtttggcggtccggggcgtagcgcgatcggtttcgtaccgtcctattcgatgcacccgatcatctccgacggcacccacacggaatggatcgaggcgtcccgcgccaatgacttcggtctcgacgtggacgtcgccgtcgcggctgtggtcgatcgcaaacccgatgtggtgttcattgctagccctaacaacccgtccggacaaagtgtttcgttacctgacctgtgtaagctgctggacgttgcgcccggaattgcgatcgtcgacgaggcctacggcgagttctcctcgcagcccagcgcggtgtcgctggtcgaggagtatccgagcaagctcgtcgtcacgcgcaccatgagcaaggcattcgctttcgccggcggcaggctcggatacctgatcgctacgcccgcggtgatcgacgcaatgctgctggtgcggttgccgtatcacctgtcgtcggtcactcaagccgcggcccgggccgcgctgcggcactccgacgacaccttgagcagtgtcgccgcactgatcgccgaacgcgaacgcgtaacaacctcattgaacgacatgggttttcgagtcatcccaagcgatgccaacttcgtgttgttcggcgagtttgccgatgcgccggccgcctggcggcgctatctggaggccggcattttgatccgcgacgttgggattcccggctatctgcgggccaccaccgggctggctgaggagaacgatgcgttcctgcgggcaagcgcccggatcgccaccgacctggtccccgtcacccgcagtcctgtaggagcgccatga

SEQ ID NO: 228 - DNA, 399 bp, Mycobacterium Tuberculosis
atggaagctagcgggcgtcaacgtcgctacgccgcggccggttcggtcgtgctattggccggcgcgcttggctacatcggacttgtcgacccgcacaactcgaattcgctatatccaccgtgcctattcaagttgcttacgggctggaactgccccgcgtgcgggggtctgcggatgatccacgatctgctacacggtgagctggcggccagcatcaacgacaatgtctttctgcttgtcggcgtcccagtgctggccagttgggtcctgctgcgccgccgccacggcgacttggcgctcccgataccggtgatgattgctgtggcggtcgcggtgatcgcgtggacggtgctgcgcaacctgccaggcttcccgttagtgccgacgatcagcggatag

SEQ ID NO: 229 - DNA, 1731 bp, Mycobacterium Tuberculosis
atgaaccgaccgagtgctgtgagtcgccgccagcgggacctgctggccgcgtctgggctgttgggtccccggttgccccggatcttggcggccgtcgcgctgggcgtgctgtcgctgggcagcgcgctggccctggccggggtgtcggcctggctgatcactcgggcctggcagatgccgcccgtcctggacctgtcggtggcggtcgtggcggtgcgggcgttcgcgatttcgcgcggcgtgctgcactactgcgagcgactggccacccacgacaccgcgttgcgggccgccggccgggcccgcacccttatctatcaccggctggcccacggaccggcggcggccgccgtcgggctgcacagcggggacctggcagcacgcgtcggcgcggacgtcgacgaactggccaacatgctggtgcgtgctctggtgccgatagccgtcgcagcggtgctggcagtagccgcgaccgcggtcgtcgcggccgtttcggtgccagccgccgtggtactggcggtctgccttttggttgccggcgttgttgcgccctggcttgccggcagaaccgccgcagcgcaggaagcgatcgcccgccaacatcggggcatgcgcgacacgtcggcgatgatcgcccttgagcatgcccccgagcttcgtgtcgccggtgccctacgcaacgtcatcgccgactcacaacggcgccaacatgcctgggccgatgcgctcgacgccgccgcacgaacgggggcgatcgccgaggccatgccgaccgcggcgatcggggccagcctgctgggcgccgtggtggccgggatcggcatggcccccacggtcgcgcccacaacactggccatcctgatgttgttgccgctgtccgcattcgaggcgaccgttgcactacccgccgccgccgtccagttgacacggtcgcgcatcgcggcggctcgtctgctcgacctgactgggtcaaaccgggtccgcgagaccgaatccacggtgtcggcgcgactgccggtaggtaccggggtgctagcggccgacgtgtgttgcggtcaccaagaggcgcagtcgatccgggtgacgattgacctaccgccgggtgcccggctggccgtcaccggcgcgagcggcgccggcaagacgacgctgttgatgacgctggccggcttgctgccgccggtgcacggccgggtgttgctggacggaactaacctgagcgacttcgatgaggatgaattacgcagcgctgtcagctttttcgctgaagatgcgcatatctttgctaccaccgttcgggacaacttgctgaccgcccgaggagactgccccgatgacgaactgatcgaggccctggatcgggtcggcctgtgcggctggctcgccggcctgcccgaggggttgtcgacggtgttgatcggtggcgcgcaagcggtctcggcgggtcagcgcagaaggttgctgctcgcccgggcggtgctttccccggctcggatcgtgttgctcgacgaacctgtcgaacacctcgacgccgccaacgccgaccttctgcgcgatctgctggccccgaactccgggatcatgagcgctatgcggaccgtggtggtagccacccaccacctgcccaacgacattcaatgcgccgagctgtccatagcgacggatcagagatgtcgccgccgcgggacgaactccagcgacaacaacaccaacgccagcgcaaagacctga

SEQ ID NO: 230 - DNA, 1458 bp, Mycobacterium Tuberculosis
atgaatgtcgtcgacatttcgcggtggcagttcggtatcaccaccgtctatcacttcattttcgtaccgctgaccatcggcctggccccgctgatcgcggtcatgcaaacgctgtgggtcgtcaccgataaccccgcctggtatcgcctcaccaaattcttcggcaaattgttcctgatcaactttgccatcggcgtggcgaccggaatcgtgcaggaatttcagttcggcatgaactggagcgagtactcccgattcgtcggcgatgtcttcggcgccccgctggccatggagggcctggcggccttcttcttcgaatccaccttcatcgggttgtggatcttcggctggaacaggctgccccggctggtgcatctggcctgcatctggatcgtcgcaatcgcggtcaacgtgtccgcgttcttcatcatcgcggcaaactccttcatgcagcatccggtcggcgcgcactacaacccgaccaccgggcgtgccgagttgagcagcatcgtcgtgctgctgaccaacaacaccgcacaggcggcgtttacccacactgtcagcggtgcgctgctgaccgccgggaccttcgtcgccgcggtgagcgcctggtggctggtccgttcgagcaccacgcacgccgactcagatacccaagccatgtatcgtcccgcgaccatcctggggtgttgggttgcgttggccgccacggccgggttgttgttcaccggcgaccaccaaggcaagctgatgttccagcagcagccgatgaagatggcgtcggccgaatcgttgtgcgatacccagacagatccaaacttctctgtcctgacggtcggccggcaaaacaactgcgacagcctcacccgtgtcatcgaagtgccctatgtgttgccgttcctcgccgagggccggatcagcggtgtgacgttgcagggtatccgcgatctgcagcaggaataccagcagcgcttcggaccaaacgactaccggcccaacctcttcgtcacctactggtcatttcgcatgatgatcgggttgatggcgatcccggtgctgttcgcactgattgcgctctggctcacccgtggcggccagatccccaatcaacgctggttctcctggctggcgctgctaaccatgcccgccccgttcctggccaacagcgccggatgggtgttcaccgagatggggcgccagccctgggtcgtcgtccctaacccgaccggtgatcagctggttcgactcaccgtcaaagcaggcgtctcggatcactccgccaccgtggtcgccacgtctttgctgatgttcaccttggtctacgcggtacttgcggtcatctggtgctggctgctcaagcgttacatcgtcgaaggccccctggaacacgacgcggaaccggctgcgcacggggcaccccgcgacgacgaggtagcaccattgtcgtttgcttactga

SEQ ID NO: 231 - DNA, 588 bp, Mycobacterium Tuberculosis
atgtgtcacactgcgcccatggaaccaagccctgtcgtgagccctctcccaaggttgttgccgcatctctggaagtccactctggcatcgggaattctgtcgctgatcctgggcgtcctggtgctggcctggccaggaatatccattctcgttgctgccatggcgttcggtgtctacctcctgattaccggtgtcgctcaggttgcgttcgcgttcagcctgcatgtttcggcgggcggccggatcctgttgttcatcagcggtgccgcctcactcatcctggctgtgctggcctttcgccatttcggtgacgcggttctgttgctggccatctggatcggcatcgggttcatcttccgcggcgtcgccaccacggtttcggcgattagtgatccgatgctgccgggacggggatggtccatcttcgtcggcgtgatcagcctcatcgccggcattgtggtgatggcatcgccgttcgagtccatctggatactggcgttggtcgtcggcatctggctcgtggtgatcggcacatgcgagatcgcgtcgtcgttcgccatccgcaaggcttcgcagacgctcggctga

SEQ ID NO: 232 - DNA, 1671 bp, Mycobacterium Tuberculosis
atgcatgcgagtcgtcccggcgcaccgccgcacgccgggctgcccagtcgccgaaccgccggtgaccaggatcatcgcgcggaccctaaggtgacccgcatcatgtccgcctccactctggagcagcccgcggcagcacacgtcgacgagttggtggcgcggatgcgcggccggctgctcgacccgctggcgattgcagtgctggccgcggtcatcagcggcgcctgggcaagcaggccatcgttgtggttcgacgagggggcaacgatctcggcttcagccagccggacattgccagagctatggagtctgctgggccatatcgacgccgtgcacggcctgtactacctgttgatgcatggctggttcgccatatttccgcccaccgaattatggtcgcggcttcccagctgcctggccattggagcggccgccgccggcgtggtggtttttgccaaacagttttcgggacgcaccacggcggtgtgtgcgggagccgtgttcgcgattctgcccagggtgacgtgggccggaatcgaagcacgctcctccgcgctgtcggtagcagccgccgtctggctgaccgtattactcgtggccgcggtgcggtgcaacacccagcggcggtggctgctctacgcgctggttttgatgctgtcgatcttggtcagtatcaacctggccctgttggtaccggcctatgcgacgatggtgccgctgctggcgtccgggaaatcacgcaaatctcccgtgatctggtggacggtcgtcacggcagccgcgctcggggccatgacaccgttcatactgttcgcccacggccaggtttggcaggtcgggtggatcgcagggttgaacagaaacatcattctcgacgtcatacaccgccagtatttcgatcacagtgttccgttcgccatcctcgcgggcctcatcgtcgctgccggcatcgcggcgcatctggccggagctcgtggacccggtggcgatacccaccggctcgtgctcgtcagcgcagcctggatcgtcgtgcccaccgccgtcgtcctcatctactcggcgaccgtcgaaccgatctactacccgcgctacctgatcctcaccgcccccgccgcggccgtcatcctggcggtttgcgtcgtcaccatcgcccgcaagccgtggctcatcgccggggtcgtgtttctccttgccgccgcagcgtttccgaactacttcttcacacagcgggggccgtacgcgaaagagggctgggattacagccaggtggcagatgtcatcagcgcccatgccaagcccggggattgcctgctggtggacaacaccgcgggttggcgacccgggcccatccgcgccctgctggccacccggccggcggcgttccggtcgctgattgacgtcgagcgcggcacctacggccccaaggtcggcactttgtgggatggccatgtcgctgtgtggcttacgacggccaagatcgacaagtgccccacgctgtggacgatagccaatcgtgacaagtcgttgcccgatcatcaggtcggcgaaatgttgtcaccgggaacaggcttcgggcgcacgcccgtataccggttcccgagctacctcggcttccgcatcgtcgagcgctggcagttccactactcgcaggtggtcaagtcaacgcggtaa

SEQ ID NO: 233 - DNA, 1470 bp, Mycobacterium Tuberculosis
atggctcagaatgaactggtgaccgcgtcgacgccgccagccgcgacgcagccgttagcagtaggccacacatcgctgatgcacggttgggtgccgctcgctgtccaggtcgtgaccgcggtcgtgctggtgctggcggcagggtggcgatcacgtcactggcaacggcggtggctgccgacggccgccgctatcggggccaccctggcatgggggacgcgctggtatgtcaccggcaacggcctggccaacgaacggccgccgagcacgctgtggatctgggtcgcgttgaccggcgcggcggcgacggtgttgatcctgggctggcgcagcgcgcggtggtggcgccgcggcgcgtcgctgctggccgtgcccctctgtctgctcagcgcgaccttgacgctcaacctgtgggttggctacttcccgaccgtgcagaccgcgtggaaccagctcacctccggcccgttgcccgaccaggccgatcaggccgctgttgccgcactggcgcacagtggggtgcggccgtcgcacggcacgttgttgccagtggtgatcccttccgacgcatcacacttcaagcatcgcggcgaactggtgtacctgccgccggcctggttcgaccgagagcatcgttccgagaaccctccgccgccgcagctgccgacggtgatgatgatcggcggtcaattcaacacacccgccgattgggcgcgagccggtaacgcggtgaagacgctcgacgactttgcggccgcccacagcggcaatgctcccgtcgtggtattcgtggattccggcggcgcgttcaacaacgacaccgaatgcgtcaatggacggcgtggcaacgcggccgaccacttgactaaagatgttgtgccctacatggtctcgaaattcggcgtcagtcccgaacagaccagctggggcatcgtgggttggtcgatgggtgggacctgcgcggtggatctgaccgtcatgcacccgacactgtttagcgcgtttgtcgacatcgccggtgatttctacccgaacgctggcaacaagacgcaaaccatcgtcaggttgttcggcggcaacgaagacgcctggtcggcgtttgacccgacgacggtgatcacccggcatggcagctacaccggactgtcgggttggttcgcgatctcttcgccgggtccaccctcgcccgacaacgctgtcgccgataccaccacgatgcggctggccggtcgcgatgccgccgccaacccaggcaaccaggccgctgccgccaatgcactgtgcgccctcggccgcgccaacggcatctactgcgccgtggttccacaaccgggcaagcacgactggcctttcgccgaccgggttttcgctgcggcgctgccatggctggccggccaactggccactccgggagtgcctaagatcccgttgccgggtacgacacagcagatcgccggtaccggcagatag

SEQ ID NO: 234 - DNA, 606 bp, Mycobacterium Tuberculosis
atcagcactgaaacccgcgtcaacgagcgcatccgcgtacctgaagtccgattgatcggcccagggggggagcaggtaggcattgtgcgtatcgaagacgcacttcgcgtcgccgcggacgcagatctcgaccttgtcgaagttgctcccaatgccagaccgccggtctgcaagatcatggactacggcaagtacaagtacgaggccgcgcagaaggcgcgcgaatcccgcagaaaccaacagcagaccgtcgtcaaagaacaaaagctgcgaccaaagattgacgatcacgattacgagaccaaaaagggtcacgtcgtccgcttcttggaggcgggatcgaaggtcaaggtcaccattatgttccgtggacgtgagcagtcgcggccggagttgggctatcgattgctgcagcggctgggtgcggacgtcgccgattacggattcatcgagacgtccgccaagcaggacggacgcaacatgacgatggtgctggcaccgcaccgcggtgcgaagacccgcgctagggcccgccacccgggtgaaccggccggcgggccgccgcccaagcccacggccggtgacagcaaagccgcaccgaactag

SEQ ID NO: 235 - DNA, 513 bp, Mycobacterium Tuberculosis
atgagccgcgccaaggccgcgcccgttgcggggcccgaggtcgccgcaaaccgcgccggccgccaggcgcgcatcgtggcgatcctgtcgtcggcgcaggtgcgcagccaaaacgaactggcggcgctgctggccgccgagggcatcgaggtcacccaagccacactgtcacgcgatctggaagagctcggcgcggtgaaactgcgcggcgcggacggcggcaccggcatctacgtggtgcccgaggacggcagcccggtgcgcggcgtctcgggcggtaccgaccggatggcgcggctgctcggtgagctgctggtgtcgaccgacgacagcggcaacctcgcggtgttgcgcaccccgccgggcgcggcgcactacctggccagcgccatcgaccgcgcggccctgccccaggtcgtcggcaccatcgccggtgatgacaccatcctggtggtggcccgcgagccgacgaccggcgcgcaactggccggcatgttcgagaaccttcggtaa

SEQ ID NO: 236 - DNA, 933 bp, Mycobacterium Tuberculosis
atgacgatcaccgaccccgcggtatccgcacacgcggatgcgacgatcgggctgttcgaaatcaccgatcacatcacgatcgattccacccaaggtgcccacaccgtcgagatgtggtgcccggtcatcggtgacggcgcgtttcaacgcgttctggacgtcgaggtgaccagcgaggatccctatgacctcacgcgtgagccggagttcgggaacctgatgttgtacagccggctgcgcttggcgacggcggcgagttggtctatccgctatgttgtggaacgccgggcgatcgggcatgctccggatccggcacgggcccgcccgttggccacggcgcaattgttcagccgcgccttgatccccgaagcacatgtcgatgtcgatgagcgcacccgtacgttggcccaagacgtcgtcggccccgagaccaacccgctcgaacaggcccgtcgcatctacgactacgtcaccggcgccatggactacgacgcgacgaagcagtctttcctgggcagcaccgagcatgccctgacctgctcggtgggcaactgcaacgacatccacgcattgttcgtctcgctgtgccgatcggtcgacatccccgcacgatttgtgctcggtcaggccttggagctaccgcagcccggtgcgcaggattgcgaggtgtgcggctaccactgctgggcggaattcttcgtcgctgggctgggttggctaccggcggacgcctcctgtgcgacgaagtacggcacccacggcctgttcgcgaacctgcaggccaaccacatcgcgtggtcgatcggccgcgacatcctgctcgccccaccacagcgggcgggccggagcctgttcttcgccggcccctacgccgagattgacggcgaaacacatccggcgcaacgccaaatccgttttactgcaatgacataa

SEQ ID NO: 237 - DNA, 549 bp, Mycobacterium Tuberculosis
gtgactcattcccgtctgattggcgcacttaccgtagtcgcaattatcgtcactgcatgtggttcgcaaccgaaatcccagcccgcagtggcacctaccggggacgcggccgctgccacccaggtgccggcgggccaaaccgttcccgcccagctgcagttcagcgccaaaacccttgatgggcacgactttcacggggaaagcctgctgggtaagcccgcggtgctgtggttctgggcgccctggtgtccgacgtgccaaggcgaagcgccggtagtcggccaggtcgccgcgtcacacccggaagtgacgttcgtcggggtggccggcctggatcaagtacccgcaatgcaggagttcgtcaacaaatacccggtgaaaacgtttacccagctggctgataccgacgggtcggtctgggcgaatttcggtgtcacccagcagcctgcgtacgcgttcgttgacccgcacggcaacgtcgacgtcgtcaggggtcggatgtcgcaggacgaactgacgcggcgcgtcacggcgttaaccagccgttga

SEQ ID NO: 238 - DNA, 918 bp, Mycobacterium Tuberculosis
gtgttgcctcaacgcccaaactgcaccaaactgtttcgcccacggcggggcgtgtctgagaggtatcgcgtgaccaccgcccataacggatccgctccgcgttttcaacgtacccgctctggctacgacccggtcgcagtcaatcattacatcgccgaactcgtgctgcgtcagcaggcgcagcactgtgagattgaaacgctcaaggcagaaatagccagtctgaaggacgaaaacgctgccctgaaggacacctcgccgtcagcacaggcggtgaccgatcggatggcgaaaatgcttcgactcgctgtcgacgaggtcttccagatgcagtcggaggcacgggccgaggccgcaacattagtttctgcggctagggatgaggcggaagcggtccgaacgcagaagcgagaaatgctggcggatatgaacgcccggcaaagagcgctggagtccgagcatgccgacgtgatgcgccgcgctcgtgaagaggctgaacagcttgtggcgcaggcaaccgccgaggtggagcggatgcgtgtcatcgatgccagacgccgtgagaaagccgagcaggaacttgatgccgaaatcatcaggcttcgcaccgatgcccaatttcagatcgacgatcagctgcaggccacacagcaggagtgtgagaagcggcttggcgaagccaaaatcgaggccgatcgacggctgcatgttgccgacgagcagattgagcacggcctcagcgaggctcggcgaacgttggaagagatcagccagcggcgagtcggcatcctcgaacaactagcgcgtattcacgcacagctcgagaatattccagcgctcctggaatcggctcgacatagcgagacggagccactgcagtccataaacggcgcggtcgctgagctacgggccatttag

SEQ ID NO: 239 - DNA, 3000 bp, Mycobacterium Tuberculosis
gtggtggatctcaatttttcgatggtcacgcgaccaatcgagcgcctggtggccacggcgcagaacggtctggaagtcctgcgactcgggggcctggaaaccggcagtgttccgtcgccgtcccaaatcgttgagagcgtaccgatgtacaagctgcggcggtattttccgccggacaaccgcccgggacagccaccggtgggtccgccggtgctgatggtgcacccgatgatgatgtcggcggacatgtgggacgtcacccgtgaagacggcgcggtggggatcctgcacgccagcgggctagatccctgggtcatcgacttcggctcacccgacgaggtcgagggcggaatgcgccgtaacctggccgaccacatcgtcgccctcagcgaggcggtcgataccgtcaaggacgccactggccacgatgtgcacttcgtcgggtattcgcagggtggcatgttctgctatcaggccgcggcataccggcgttcgaaggacatcgccagcgtggtcgcgttcggctcgccggtggacaccctggccgcgttgcccatgggcatcccggcgaacatgggcgctgcggtcgccgatttcatggccgatcacgtcttcaatcgcttggatatcccaagctggatggcgcgcatgggttttcagatgatggacccactcaaaaccgcgaaggcccgggtggacttcgtgcgtcagttgcacgaccgcgaggcactgctgccgcgggaacaacagcgccggttcctggaatccgaaggatggatcgcctggtcgggcccggcgatctcggaactgctcaagcagttcatcgcgcacaaccgaatgatgacgggtggtttcgccatcagcggccagatggtgacgcttaccgatatcacttgcccgatactggcgttcgtcggtgaggtcgacgacatcggccagccggcgtcggtacgcggcatccggcgggccgcgcccaactccgaggtctacgaatgtctcatccgggcagggcatttcggtctcgtcgtgggatcccgagcggcacaacagagctggccgaccgtggccgactgggtgcgctggatctccggcgacggcaccaaaccggaaaacatccacctgatggccgatcagccggccgaacacaccgatagcggtgtggctttcagctcccgggtcgcgcacggcatcggggaggtctcggaggctgcgttggcgctggctcgcggcgcggccgacgcggtcgttgcggccaacagatcggtgcgcacgctggcggtggagacggtgcggacgctgccgcgactagcccggttgggtcagctcaacgaccacacccggatctcgctgggccgcatcatcgacgaacaggcacacgatgccccgaagggtgaattcctgttgttcgacgggcgcgtgcacacctatgaggcggtaaaccggcggatcaacaatgtcgttcgtggcctcatcgcggtcggggtgcggcagggtgaccgtgtcggcgtgctgatggagactcggcccagcgcgctggtcgccatcgccgcgctgtctcggctgggagcggttgccgtggtgatgcggccagacaccgacctgtccgcgtcggtccggctcgggagagtgaccgagatcctgaccgaccctaccaatctggatgctgcgcgccagttgcccggacaggtgctggtgttgggtggtggtgaatcgcgtgatctggatctgccggccgacgcacttgaacagggccaagtcatcgacatggaaaaaatcgacccggacgccgtcgagttgccggcgtggtatcgaccgaatcccggattggcgcgggatctggcgttcatcgcgttcagttcggccgacggcgacctggtggccaagcagatcaccaactaccgctgggcggtgtcggccttcgggaccgcctcgacggcggccctcggccgcagagacacggtgtactgtttgacgccgctgcaccatgagtccgcactgttggtcagcctgggcggcgcggtcgtgggcggaacccgtatcgcattgtcccgcggcttgcgcccggaccggttcgtggccgaggtacgccagtacggcgtcaccgtcgtctcctacacatgggccatgctgcgtgacgtggtcgacgatccggcgttcgtgttgcacggcaaccatccggtgcggttgttcatcggctcgggcatgccgaccggattgtgggagcgggtcgtcgaagcgttcgcaccggcgcacgtcgtcgagtttttcgccaccaccgacggacaggcggtgctggccaacgtggctggcgccaagatcggcagcaagggccgtccgttgcctggcgccggacgtgtcgaacttggggcctacgacgccgaacatgacctgatcctggagaacgaccgcggcttcgtgcaggtcgccggtgtcaaccaggtcggggtgctgctcgcacaatccagagggccgatcgatccgaccgcgtcggtcaaacgcggtgtcttcgctcccgccgacacctggatatctaccgactacctattctggcgtgacgacgatggggactactggctggcgggtggacgcggctcggtggtgcgcactgcgcgcgggatggtttacaccgagccggtcaccaacgcgttgggcctcatcaccggtgtcgacctcgcggtgacctacggtgtattggtgcgcggtcgccacgtcgcggtgtcggcggtgacgttgctgcctggagcgaccatcacagccgccgacttgaccgaagccgtggcgagcatgccggtggggctgggacctgacatcgtgcacgtggtgccgcagctaacgctcagcggtacttaccggccaacggtcagcgcgttgcgggccaacgggattcccaaggcgggccgtcaggcatggtatttcaactccggcggcaacgagtaccggcggttgacgccggcggtccgcaccgagttgaccggccagcatcggcgcggcaatgcttga

SEQ ID NO: 240 - DNA, 1275 bp, Mycobacterium Tuberculosis
atgtctggcatgatcctcgatgagctcagctggcgcgggttgatcgcgcagtcgaccgacctcgacacgttggccgccgaagcacagcgcgggccgatgacggtgtacgccggcttcgatcccaccgcgcctagcctgcatgccggacatttggtgccgctgctgacgttgcggcgctttcagcgcgccggtcatcgccccatcgtgctggccggcggggccaccggcatgatcggtgatccacgtgacgtcggcgagcgcagtctcaacgaggccgacaccgtcgccgaatggaccgaacggatccgtgggcagctggagcgcttcgtcgacttcgacgactcaccaatgggcgcgatcgtcgagaacaacctggaatggaccggctcactatcggctatcgagtttctacgtgatatcggcaagcacttctcggtcaacgtgatgctggcccgcgacaccatccggcggcgtctggcgggggaggggatctcttacaccgaattcagctacctgttgctgcaggccaacgactacgtcgaattgcaccggcgccacggctgcacgctgcagatcggtggtgcagatcagtggggcaacatcattgccggcgtccggttggtgcgccagaagctcggtgccaccgtgcatgcgcttaccgtccccttggtgaccgctgccgacggcaccaagttcggcaaatcaaccggcggcgggagcctgtggttggatccccaaatgaccagcccctatgcctggtaccagtacttcgtgaacaccgcggacgcggatgtgatccgctacctacggtggttcaccttcttgtcggccgacgagttggccgagctggaacaggcgacagcgcaacgcccgcaacaacgggccgcccagcgccggctcgccagcgagctcaccgtcttggtgcatggcgaggcggcgaccgcagccgtcgagcatgccagccgggcactcttcggtcggggcgagttggcccgtctggacgaggcgacactggctgctgcgttgcgggaaaccacggtcgccgaactcaaaccgggcagtcccgacggaatcgtcgacttattggtggccagcggcctgtcggccagcaagggcgcggcgcggcgcacgatccacgagggtggggtgtcggtcaacaacattcgggttgataacgaggaatgggtgccgcaaagttcggacttcttgcacggccgctggttagtgctacgtcgtggaaagcggagtatcgccggggtggaacggattggctga

SEQ ID NO: 241 - DNA, 177 bp, Mycobacterium Tuberculosis
atgaccatcgatcctgaccagatccgtgccgaaatcgacgccctacttgcttcgctgcccgaccccgccgacgccgagaacggaccgtctctggccgaactcgaaggcatcgcacgtcgtctttccgaggcgcacgaggtgttgttggccgccctggagtcggcggagaagggttga

SEQ ID NO: 242 - DNA, 1761 bp, Mycobacterium Tuberculosis
gtgcgaaagcacccgcaaaccgctaccaagcacctcttcgtcagcggcggcgttgcttcctcgctcggcaagggactgaccgccagcagcctaggacaattgttgacggctcgtgggttacacgtcacgatgcaaaagctcgacccgtacctcaacgtcgacccgggtaccatgaacccgttccagcacggcgaggtcttcgtgaccgaggacggtgccgaaaccgatctcgacgtcggccactacgaacggttcctcgatcgcaatttgcccggctcagcgaatgtgactaccgggcaggtgtattcaacggtgatcgcgaaggagcgccgcggcgaatacctgggcgacaccgtgcaggtgatcccccatatcaccgacgagataaaacggcgcatcctggcgatggcccaaccggacgccgacggtaaccgcccggacgtggtcatcaccgaaatcgggggcactgtcggcgatatcgagtcacagcccttcctggaggcagcgcggcaagtccggcactatctcggccgggaggacgtgttttttctgcacgtgtcgctggtgccctacctggcgccgtcgggtgagctcaaaaccaagccaacacagcactcggtggccgcactgcgcagcattgggattaccccggacgcgttgatcctgcgctgcgaccgcgacgttcccgaagcgctgaaaaacaagattgcgttgatgtgtgacgtcgatatcgacggcgttatctccaccccggacgcgccctccatctacgacatacccaaggtattgcaccgcgaggagctcgatgcgttcgtggtgcgccgactcaatctgccgttccgcgacgtcgattggaccgaatgggacgacctgctgcgccgggttcacgaaccacatgagacagtgcgaattgctttggtgggcaagtacgtcgaattatccgacgcttacctctcggttgccgaggcattgcgtgccggcggattcaagcaccgggccaaggtcgagatctgttgggtggcatccgacggttgtgaaacgaccagtggtgccgcggcggcgctcggcgatgtgcatggggtgctcattccgggcggattcggcatcaggggcatcgagggcaagatcggtgccattgcatacgcgcgggcgcgcgggttgccggtgttggggctgtgcctcggtttgcagtgcattgtgatcgaggccgcgcgatcggtcggtctcaccaacgccaattcggccgaatttgatcccgacacaccagatcccgttatcgccacgatgcccgatcaagaagaaatcgtggccggcgaggcggatctgggcggtaccatgcgtctcgggtcctaccccgccgtgttggagccggattcggttgttgcccaggcataccaaactacccaggtgtccgagcggcatcgccaccggtacgaggtcaacaacgcgtaccgagacaagatcgccgaaagcggcctgaggttttccgggacgtcacctgacggacacttggtagagttcgtcgagtatccgccggatcggcatccgttcgttgtcggcacccaggcccaccccgagttgaagagccgacccacccggccgcacccactgtttgtcgcattcgtcggggcagccatcgattacaaggcgggtgagttgctgcctgtcgagatccccgagatccccgagcacacacccaacggtagctcccatcgggacggcgtgggccagccgctaccggaacctgcgtctcgtggctga

SEQ ID NO: 243 - DNA, 1158 bp, Mycobacterium Tuberculosis
atggattttggggcgttgccaccggaggtgaactccgggcgcatgtattgcggcccgggctcggcaccgatggttgccgcagcgtccgcgtggaacgggctggccgccgagctcagtgtggccgccgtcggctacgagcgggtgatcacgacgctgcaaaccgaagaatggctgggtccggcgtcgacgttgatggtcgaagcggtcgccccgtatgtggcgtggatgcgagccaccgccatccaagctgagcaggcagccagtcaggcgcgtgcggcggcggccgcttacgaaaccgcgtttgccgccattgtgcccccgccgctgatcgcggccaatcgcgcgcggctcacgtcgctggtcacgcataacgtgttcggtcaaaacaccgcatcaatcgcggccaccgaagctcaatacgctgaaatgtgggcccaagacgccatggccatgtacggttacgcgggctcctcggcgaccgcgaccaaagtgacgccgtttgccccgccgccgaacaccaccagcccatccgccgcggcgacgcagttgtccgcagtcgccaaagccgccggcacctcagccggcgcggcgcagagcgcaatagcggagctgatcgcccacttgcccaacacgctgctgggcctcacctcgcccctgtcgtccgcgttgaccgccgccgcgaccccggggtggctggaatggttcatcaactggtatctgccgatatcacagctgttttacaacaccgtgggtttgccatatttcgccattggtattggcaacagccttattacatcgtggcgggcgctgggatggatcggtcccgaggccgccgaagctgccgccgcggcgccggcggccgtcggcgccgcggttggcggtaccggacccgtatccgcgggtctaggcaacgcggccaccatcggcaagttatcgctgccgcccaactgggcaggggccagtccgagcctagccccgaccgtgggttcggcctccgcacccctggtcagcgatatcgtcgagcaaccggaggccggtgcggcgggaaacctgttgggcggcatgccgctagccggttcgggcaccggtacggggggtgcgggtccccgctacgggttccgggttacggtgatgtcccggccgccgtttgccggataa

SEQ ID NO: 244 - DNA, 1185 bp, Mycobacterium Tuberculosis
atgaccctcgatgtcccggtcaaccaggggcatgtccccccgggcagcgtcgcctgctgccttgttggggtcaccgccgttgctgacggcatcgccgggcattccctgtccaactttggggcgttacctcccgagatcaattcgggtcgtatgtatagcggtccgggatccgggccactgatggctgccgcggcggcctgggacgggctggccgcagagttgtcgtcggcagcgactggctacggtgcggcgatctcggagctgacaaacatgcggtggtggtcggggccggcatcggattcgatggtggccgccgtcctgccctttgtcggctggctgagtaccaccgcgacgctagccgaacaggccgcgatgcaggctagggcggccgcagcggcctttgaagccgccttcgccatgacggtgcccccgccggcgatcgcggccaaccggaccttgttgatgacgctcgtcgataccaactggttcgggcaaaacacgccggcgatcgccaccaccgagtcccaatacgccgagatgtgggcccaagacgccgccgcgatgtacggctatgccagcgccgcggcacccgccacggttttgactccgttcgcaccaccgccgcaaaccaccaacgcgaccggcctcgtcggccacgcaacagcggtggccgcgctgcgggggcagcacagctgggccgcggcgattccatggagcgacatacagaaatactggatgatgttcctgggcgccctcgccactgccgaagggttcatttacgacagcggtgggttaacgctgaatgctctgcagttcgtcggcgggatgttgtggagcaccgcattggcagaagccggtgcggccgaggcagcggccggcgcgggtggagccgctggatggtcggcgtggtcgcagctgggagctggaccggtggcggcgagcgcgactctggccgccaagatcggaccgatgtcggtgccgccgggctggtccgcaccgcccgccacgccccaggcgcaaaccgtcgcgcgatcgattcccggtattcgcagcgccgccgaggcggctgaaacatcggtcctactccggggggcaccgactccgggcaggagtcgcgccgcccatatgggacgccgatatggaagacgactcaccgtgatggctgaccggccgaacgtcggatag

SEQ ID NO: 245 - DNA, 957 bp, Mycobacterium Tuberculosis
ttgcctgcgggtctcccgggccaggcgtcggtagccgttagactttcctgcgatgtcccccctgacgcccgtcaccacgagccacgaccgggtatgaccgaccaccccgacaccggcaacgggatcggcctcaccggacggccaccacgggcaatccctgaccccgcgccgcgcagctcgcacggcccggccaaggtcatcgcgatgtgcaaccagaagggtggcgtcgggaagacgacgtcgacgattaacctgggtgccgcgctcggtgagtatggccggcgggtgctgctggtggatatggatccgcaaggagcgctgtccgcgggcctgggcgtgccgcactacgagctggacaagaccatccacaacgtgctggtggagccccgggtgtcgatcgacgacgtgctgatccactcccgggtgaaaaacatggatctggtccccagcaatatcgatctgtccgcggcggagatccaactggtcaacgaggtgggtcgcgagcagacgttggcccgggcgctgtacccggtgctggaccgctacgactatgtgctgatcgactgccagccgtcgctgggcctgctcaccgtcaacgggctggcctgcacggacggcgtgataattccgaccgagtgcgagttcttctcgctgcgcggcctggcattgctcaccgacaccgtcgataaggtgcgcgaccggcttaatccgaagctggatatcagcggaatcctgatcacccgctacgatccgcggaccgtcaactcgcgagaggtcatggcccgtgtcgtggaacggttcggtgacttagtgtttgacaccgtgatcacccgcacggttcgtttcccggagaccagcgtcgcaggcgaacccattaccacctgggcgccgaagtcggcgggtgccctggcctaccgtgcgctggctcgcgagttgatcgaccgatttggcatgtga

SEQ ID NO: 246 - DNA, 696 bp, Mycobacterium Tuberculosis
gtgaccgaacatatgcccgaacacgatccgagctatggcatcccggatatcgctgagcccgcggagctggatgccgacgagcttaagcgtgtgctagaggcgctgctgttggtgatcgacaccccagtgacagccgacgcgttggccgcggccaccgaacagccggtctaccgggttgcggcaaagctacagttgatggccgacgagctcaccgggcgtgacagcggcatcgacctgcgccacacgagcgagggttggcggatgtacacccgcgcccgattcgcgccctatgtcgagaagctgttgctggacggcgcgcgaaccaagctcacccgggccgcgctggagaccctggccgtggtggcctaccgccagccggtcacacgagcgcgggttagtgcggtgcgcggggtcaacgtggacgccgtgatgcgtacgctgttggcccgcggcctgatcaccgaggttggtaccgacgccgataccggcgcggtgacgttcgccaccaccgagctcttcctggagcgcttgggattgacgtcgctgtcggagctgcccgatatcgcaccgctgcttcccgacgtcgacacaattgacgacctgagcgaatccctggacagtgagccacgtttcatcaaactcaccggtgagctggcgtccgagcagacgctgtcgttcgacgtggaccgtgattga

SEQ ID NO: 247 - DNA, 693 bp, Mycobacterium Tuberculosis
gtgagtcgcctaagcgcagcggtagtcgcgatcgacgggccggccggcaccggaaaatcctcggtgtcaaggcgattagcgcgcgagctgggcgcacgctttctggacaccggggcaatgtatcggatcgtgacgttggcggtgctgcgtgccggtgctgatccgtccgatatcgctgccgtcgagacgattgcgtcgacggtgcagatgtcgttaggctacgatcccgacggagacagctgttaccttgccggagaagacgtttcggttgagatacgcggtgacgcggtcacccgtgcggtctccgcggtgtcgtcggtgccggccgtacgcacccggctggtcgagctgcagcgaacaatggctgagggcccgggcagcatcgtcgtggagggccgcgacatcggaaccgtggtgtttccggatgcgccggtgaaaatcttcttgaccgcctcggccgaaacgcgggcccggcggcgcaacgcccaaaacgtcgcggcgggtttggccgacgactatgacggggtattggccgatgtgcgccggcgcgaccacctcgattccacccgggcggtgtcaccgctgcaagccgccggtgatgccgtcatcgtggacaccagcgatatgaccgaggccgaggtggtcgcccatctgttggagctggtcacgcggcgaagtgaggcagtgcggtga

SEQ ID NO: 248 - DNA, 1392 bp, Mycobacterium Tuberculosis
gtgacccaggacggcacgtgggtggacgaaagcgattggcaactagacgattcggagatcgcggagtccggagcggcgcctgtggtggcggtagtcggccggcccaatgtcggcaagtccaccctggtcaaccggatcctgggccgccgcgaggcggtggtgcaggatattcccggcgtgacgcgtgaccgggtctgctacgacgcgctgtggaccggacgccggttcgtcgtacaggacaccggcggatgggagcccaatgccaagggcctgcagcggttggtggccgagcaggcctcggtggccatgcgcaccgcggatgcggtgatcctggtggtcgacgccggtgtcggtgccaccgccgccgacgaggccgcggcccgtatcctgttgcgatccggcaagccggtgttcttggccgccaacaaggtcgacagcgaaaaaggcgaatccgacgccgcggcgttgtggtcgctgggcctgggtgagccgcatgcgatcagcgcgatgcacggtcggggggtggccgacctgctcgacggggtgctcgccgcgctgcccgaggtgggggagtccgcgtcggcgagcggcggtcctcgccgggtggcgctggtcggtaagccgaacgtcggcaagagctccctgctgaacaaactcgcgggtgatcagcgatcggtggtccatgaggcggcgggcaccaccgtcgacccggtggattcgctgatcgagttgggcggtgacgtctggcggttcgtcgacaccgcgggattgcggcgcaaggtcggccaggccagtgggcatgagttctacgcctcggtgcgcacgcacgccgccatcgactccgccgaagtggccatcgtcctgatcgacgcgtcgcagccgctcaccgaacaggacttgcgagtgatatcgatggtcatcgaggccggacgggcgctagtcctggcctacaacaagtgggacctggtcgacgaggaccggcgcgagctgcttcagcgcgagatcgaccgagagctggtgcaggtgcgctgggcgcaacgggtcaacatctccgccaagacgggccgggcggtgcacaagctggtgccggccatggaggatgcgctggcgtcatgggacaccaggatcgcgaccggcccgctgaacacctggctcacagaggtgacggcggccacaccgccgccggtgcgcggcggcaagcagccacgcatcttgttcgcgacccaggccaccgcgcggccaccgacgttcgtgttgttcaccacgggttttttggaggccggctatcggcggttcttggagcggcggctgcgtgagacgttcgggtttgacggcagcccgatccgggtcaacgtgcgggtgcgagagaagcgggccggcaagcgccgctga

SEQ ID NO: 249 - DNA, 831 bp, Mycobacterium Tuberculosis
atgacgttcgcctggcccctcggtgccgccgaatcgacgttggagttctacgacctgtcccacccctggggacacggcgcgccggcctggccgtacttcgaggacgtgcagatcgaacgactccacggcatggccaagagtcgtgtgctgacccaaaagatcaccaccgtcatgcattccggcacccacatcgacgcgccggcgcacgtggtggaaggaacaccgtttctggacgagatcccgctgagcgccttcttcggcaccggcgtcgtcgtctcgatcccgaagggcaaatgggggatggtcaccgccgaggatctgcaaaacgctacccccgacatccggcccggtgacatcgtcgtcgtcaacaccggctggcaccacaaatacgccgacagcgccgagtactacgcctattccccgggcttcgacaagaaagcgggcgagtggtttgcggccaaaggcgtcaaggcggtcggcaccgacacccaggccctggaccatccgctggccacggccatcgccccgcacagtcccgcggaggcacagggcggcctattgccgtgggcggtacgcgaatacgaggcgcagaccggccgcaaggtgctcgacgacttcccggactgggaaccgtgccatcgggcgatcctgtcgcagggcatctacggctttgaaaacgtcggcggtgacctggacaaggtcaccggcaagcgcgtcactttcgcggcgttcccgtggcgctgggtgggtggcgacggctgcatcgtgcggctggtggcgatcgtcgaccccaccgggagctatcgcatcgagaccggaaaggcggtctga

SEQ ID NO: 250 - DNA, 711 bp, Mycobacterium Tuberculosis
gtgcagccgtacggccagtactgcccggtagcgcgggcggcggagctgctgggggaccgctggacgctgctaatcgtgcgggagctgctcttcggcccgctgcggttcaccgaaatcgagcggggcctgcccggcatctcccgctcggtgctggcccagcggctacgccgacttcagcacgaccgcatcatcgaagcggtccccgaacacacgggcgggggctatcggttcacggtggccggcgaggagctacgccccgtgctgcagaccctgggggactgggtctcccgttggttgatggccgaccccactcccgccgaatgcgaccccgaactactcacgttgtggatctcccggcgcgtcaacaccgaggcccttcccggccggcgggtggtggtggagttccgctaccacggcgagcggccactgtgggcctggctcgtgttggaacctggggacatctcggtgtgcctgcacgatccatgcctacctgtcgacctcacggtgcgcggccatcctcgagatctgtatcgggtctacagcggccgcagcacactggccgccgagatctccgccgagcgcatcgaactggacggcctgccggcgatgcggcgcgcgttcccatcctggatggcttggagtcccttcgccccagccatgcggcaagccgtggtgtccgtagaccagatgccggaggctcatggtgggtaa

SEQ ID NO: 251 - DNA, 1557 bp, Mycobacterium Tuberculosis
atgcctgcaccctcggccgaggttttcgatcgcttgcgtaacctggccgcgatcaaggacgtcgccgcacgtccgaccaggacgatcgacgaggtcttcaccggcaagccgttgactacgattccggtcggcacggccgcggacgtcgaagcggcattcgccgaagctcgcgcggcgcagaccgactgggcgaagcgtcccgtcatcgagcgagctgcagtcatccgccgctatcgcgacctggtcatcgagaaccgcgagttcctcatggacctcctgcaagccgaggcgggcaaggcccgatgggcggcgcaagaggaaattgtcgatctgatcgcgaacgcgaattattacgcacgagtctgtgtggacctgctgaagccccgtaaggcacagccgctgctgcccgggataggcaagaccacggtgtgctatcaaccgaagggcgtggtgggggtgatctcgccgtggaactaccccatgacgcttacggtgtcggactcggtgcccgcgctggtggccggtaacgcggtggtgctcaagccggacagccagacgccgtattgtgcgctcgcgtgtgccgagctgctgtatcgggcgggtctgccgcgagcgctgtatgcgatcgtgcccggtccgggctcggtggtgggcaccgccatcaccgacaactgcgactacctgatgttcaccggttcatcggcgaccggcagccgcctcgccgagcacgccggccgccggcttatcggtttctcggccgaacttggcggcaagaaccccatgatcgtggcgcggggtgccaacctcgacaaggtcgccaaggcggccacccgtgcctgcttctcgaacgccggccagctgtgcatctccattgagcggatctacgtcgaaaaggacatcgccgaggagttcacccggaagttcggcgatgcggtgcggaacatgaagctcggcaccgcatacgacttctcggtcgacatgggtagtttgatctccgaagcacagctgaaaaccgtgtccggtcacgtggatgacgcgacggccaagggcgccaaggtgattgcgggcggcaaggctcgacccgacatcgggccgctgttctacgagccgaccgtgctgaccaacgtcgcacccgaaatggaatgcgcggccaacgagacgttcgggccggtggtctcgatctacccggtcgccgacgtggacgaagccgtcgaaaaggccaacgacaccgactacgggctcaacgccagcgtctgggccggctccaccgcggagggccagaggatcgccgcccggctgcggtcggggacggtgaacgtcgacgaggggtacgcgttcgcctggggcagcctcagcgcgccgatgggcgggatgggcctctcgggggtcggccgccggcacggtccggagggcttgctcaagtacaccgaatcacagacgatcgcgaccgcccgcgtgttcaatctcgatccgcccttcggcatcccggccacagtctggcagaagtcactgttacccatcgtgcgcaccgtgatgaagcttcccggccgcaggtga

SEQ ID NO: 252 - DNA, 549 bp, Mycobacterium Tuberculosis
atggccgttgaatccagcatgctcgccctcggcacccccgcgccgtcgttcacactgccccagccggcgaccggcgccacggtcagcctcgacgagctcacgggtcccgccctcgtcgtcaccttcatctgtaaccactgcccgtacgtgcaacacgtcgccgccggattggccacgctcggccgggacctcgccgatcaaggcgtcccgatggtcggtatctccagtaacgacgtcgtcacctacccgcaggacgggcccgatcagatggtcgccgaggcccgccgccacggctggacgttcccgtatctctacgacgaaacccaagacgtcgcccgcgccttctccgcggcctgcacacccgacacgttcgtcttcgacggccagcgccgacttgtctaccgtggtcagctcgacgactcccgcccgggcaatggccgaccggtgacggccgccgacgtccgggccgcggtcgacgccctgctcgccgggcggccagtcaaccccgaccaacgaccgtcgatcgggtgcggcatcaagtggcgctag

SEQ ID NO: 253 - DNA, 633 bp, Mycobacterium Tuberculosis
atgatcgccacaacccgcgatcgtgaaggagccaccatgatcacgtttaggctgcgcttgccgtgccggacgatactgcgggtgttcagccgcaatccgctggtgcgtgggacggatcgactcgaggcggtcgtcatgctgctggccgtcacggtctcgctgctgactatcccgttcgccgccgcggccggcaccgcagtccaggattcccgcagccacgtctatgcccaccaggcccagacccgccatcccgcaaccgcgaccgtgatcgatcacgagggggtgatcgacagcaacacgaccgccacgtcagcgccgccgcgcacgaagatcaccgtgcctgcccgatgggtcgtgaacggaatagaacgcagcggtgaggtcaacgcgaagccgggaaccaaatccggtgaccgcgtcggcatttgggtcgacagtgccggtcagctggtcgatgaaccagctccgccggcccgtgccattgcggatgcggccctggccgccttgggactctggttgagcgtcgccgcggttgcgggcgccctgctggcgctcactcgggcgattctgatccgcgttcgcaacgccagttggcaacacgacatcgacagcctgttctgcacgcagcggtga

SEQ ID NO: 254 - DNA, 285 bp, Mycobacterium Tuberculosis
atgtgcggcgaccagtcggatcacgtgctgcagcactggaccgtcgacatatcgatcgacgaacacgaaggattgactcgggcgaaggcacggctgcgttggcgggaaaaggaattggtgggtgttggcctggcaaggctcaatccggccgaccgcaacgtccccgagatcggcgatgaactctcggtcgcccgagccttgtccgacttggggaagcgaatgttgaaggtgtcgacccacgacatcgaagctgttacccatcagccggcgcgattgttgtattga

SEQ ID NO: 255 - DNA, 612 bp, Mycobacterium Tuberculosis
atgacccgcagctaccggccagctccaccgatcgagcgggtggttttgctcaacgaccgcggcgacgcgacaggtgtggccgacaaggccaccgtgcacaccggcgacacccctttgcacctcgcgttctccagctatgtgttcgatctgcacgatcagctgttgatcacgcggcgggccgccaccaagaggacgtggccggcggtatggaccaacagttgctgcgggcaccccctgcctggcgaatcgctacccggcgccatacgccggcggctcgctgccgaactcggactgaccccagatcgggtcgatctgatcctgccggggttccgctaccgggccgctatggccgatggcaccgtggaaaacgagatctgccccgtctaccgagtccaggttgaccaacagccccggccgaactcggacgaggtcgacgcgatccgctggttgtcctgggaacaattcgtgcgcgatgttaccgccggcgtaatcgccccggtatccccttggtgccgctcacaactgggctacctgaccaaacttggaccatgtccggcacagtggcccgtggccgacgactgccggctaccgaaagccgcacatggtaattaa

SEQ ID NO: 256 - DNA, 1431 bp, Mycobacterium Tuberculosis
atgccgctcgcggaaggttcgacgttcgccggcttcaccatcgtccggcagttgggatccggcgggatgggcgaggtgtacctggcccggcatcccagactgccccgccaggacgcgctcaaggtactgcgggccgatgtgtcagccgacggcgaataccgggcacggttcaaccgcgaagccgatgccgcggcgtcgctgtggcatccacacatcgtcgccgtccacgaccgcggcgagttcgacggccagctctggatcgacatggacttcgtcgacggcaccgacaccgtatcccttctcagggatcgttatccgaacgggatgcccggccccgaggtcaccgagatcatcactgcggtggccgaagcgctcgactatgcccacgaacgtcggctgttgcaccgcgacgtcaaacccgccaacatcctgatcgccaatcctgattcacctgatcgtcgaatcatgttggccgacttcgggatcgccggctgggtcgatgatccaagcggattgaccgccacaaacatgactgtgggcaccgtgtcatacgcggctccggaacagcttatgggcaacgagctcgatggacgggccgaccaatacgcactagccgcgacggcgtttcacttgctgaccggctccccgccctttcagcacgccaaccccgccgtggtgatcagccagcatctcagcgcgtcacccccggcgatcggcgatcgggttcccgagctgacaccgctggacccggtcttcgccaaagcgctggccaagcaacccaaggaccgttaccagcggtgtgtcgacttcgcgcgcgcactcggccatcgtctgggcggcgcgggtgatcctgacgacacgcgggtgtcgcaaccggtcgccgtggccgcgcccgcgaaacgctcgctgctgcggaccgccgtcatcgtccccgcggtgctggcgatgctgctggtgatggccgtcgcggtcgccgtgcgggagttccagcgtgctgacgacgagcgtgcagcgcagcctgcgcggacgcggaccaccacatcggccggcacgaccacttcggtagcccccgcgagcacaacgcgcccggcccccacgaccccgaccacgactggcgccgccgacaccgcgactgcatcgccgaccgctgcggttgtcgccatcggcgccctctgcttcccgctcggcagcaccggcaccaccaagaccggggcgacggcctactgctcgacgctgcaaggcaccaacaccaccatctggtcgctgaccgaggacaccgtggccagtccgactgtgaccgccactgctgacccgacggaggcgccgctgcccatcgagcaggaatcgccgattcgagtgtgcatgcagcagaccggccagacccgacgggaatgtcgcgaggagattcgcagaagcaacggctggccgtga

SEQ ID NO: 257 - DNA, 1287 bp, Mycobacterium Tuberculosis
atgagcccgatatggagtaattggcctggtgagcaagtctgcgcgccgtcggcgatcgtacggccgacctcggaggctgagctggccgacgtgatcgcgcaggcggcgaaaagaggcgagcgggtacgcgcggttggcagcgggcattcgtttaccgacatcgcctgcacggacggggtcatgatcgacatgaccggcctgcagcgggtcctcgacgtggaccagccgactggcctggtgacggtcgaggggggcgcaaagctacgtgcgctgggaccccaattggcgcaacgacggctcggcctggagaaccagggtgacgtggatccccaatccatcaccggcgcgaccgcgaccgcgacgcacggaaccggggtgcgtttccagaatctgtcggcgcggatcgtttcgctgcggctggtcaccgcgggcggggaagtgctcagtctgtccgaaggtgacgattacctggcggcacgggtttccctcggcgcgctaggagtgatctcacaggtcaccctgcagacggttccgctattcacgttgcatcgccatgatcagcgacgctcgctggcgcagacgctggagcgcctcgacgagttcgtggacggtaatgaccatttcgagtttttcgtattcccttacgcagataaggcgttgacgcgcaccatgcatcgcagtgacgagcagcccaaacccacgcccgggtggcagcgcatggtcggcgagaacttcgagaacgggggattgagcctgatctgccagaccggccgtcgttttcctagtgtggcgccgcgactgaaccgcctgatgacgaacatgatgtcgtcctccaccgtgcaagaccgcgcctacaaggtctttgcgacccaacgcaaggtcaggttcaccgagatggagtacgcgatcccgcgtgaaaacgggcgcgaggcgctccagcgtgtcatcgaccttgtgcgccgtcgcagcttgccgatcatgtttccgattgaggtgcgattctccgcccccgacgattccttcctgtcgaccgcatatgggcgcgacacttgctacatcgcggttcatcaatacgccggtatggagttcgaaagctacttccgcgccgtcgaggagatcatggacgactacgccggtcggccacactggggtaaacgtcactatcagaccgccgccacgcttcgtgagcgctatccgcagtgggatcggttcgccgcggttcgcgatcgcctcgatccggaccgggtgtttctcaacgactacacccggcgcgttctcggtccctga

SEQ ID NO: 258 - DNA, 747 bp, Mycobacterium Tuberculosis
gtgccgcctacggaaggaaagtcgacaacgaatcgcgacgaaggcatccaggtgctccgtcgcgccgtcgccgcgctggacgaaatagctgccgaaccgggacacctgcgcctagtcgatctctgcgagcggctggggctggccaaatcgacgactcgacgcttgctggtcggcctggtcgaggtggggctggttagtgtcgattcgcacggccgcttcgcactgggcgagcgtttgctgggattcggaagtgtcaccggagcccacatagccgcggcgttccggccgaccgtcgagcgagttgcccgcgcgaccgacggcgaaacggtcgacctgtcggtactgcgcggccagcgaatgtggtttgtcgaccagatcgaatcgtcttaccggctgcgtgcggtctcagccgtcgggctccgcttcccgttgaacggaaccgcgaatggaaaagcggcgctggctgctctcgacgacgccgacgccgaggccgcgctctgccgtctggatcccatggtggccgaaggtctacggcgcgagatcgtcgagatccggcgcaccggtatcgctttcgaccgcaacgagcacaccccagggatatccgcggctgcgatcgcacgacgcgccctgggcgacaacgtgatcgcgatctcggtgccggcgcccaccgcacgatttctggaaaaagagcagcgcataatcgccgcgttgcgcgccgccgcggactcgccggactggactcgctga

SEQ ID NO: 259 - DNA, 2175 bp, Mycobacterium Tuberculosis
atgaccgagctcgcgccttcgctggtcgaacttgcccgacgattcggcattgccaccgagtacacggactggactggccggcaggtgctggtctccgaggctacattggtggctgctcttgccgccctcggcgttcccgcccagaccgaacagcaacgcaatgacgccctggccgcgcagctgcgatcctactgggcgcgtccattgccggcgaccatcgtcatgcgcgccggagagcagacgcagttcagggtgcatgtgaccgatggcgctccggccgacgtgtggttgcagctcgaggacggcacgacacgtgccgaggtggtgcaggtcgacaatttcaccccgccattcgatcttgacggacgctggatcggcgaggccagcttcgtgttgcccgccgacctgcccctcggctaccaccgggtgaatctgcgttcgggcgactcgcaggccagcgccgctgttgtcgtgacgccggattggttggggctgccggacaagctggcaggccgtcgtgcctggggcctggccgtccagctctacagcgtgcggtcccggcagtcatggggcatcggggatctcaccgatttggcgaatctcgcgctgtggtcggcgtctgcgcacggtgccggctatgtgctggtcaatcccctgcatgcggctacgcttcccgggcccgctgggcgctcgaagccaatcgaaccatcgccctacctgccgacatcgcgacgcttcgtcaaccctctctaccttcgggtggaggccattccggaactcgtcgatctgcccaagcgtggccgggtgcaacggttgcgcaccaacgtgcaacagcacgccgaccagctcgacaccattgaccgcgacagcgcctgggcggccaaacgcgcagcactcaagctcgtgcaccgggtgccgcggtcggcgggtcgcgagctggcctacgccgccttccgtacccgcgagggccgcgccctcgacgacttcgccacctggtgcgcgctggccgagacgtacggcgatgattggcatcgatggccgaaatcgctgcggcatcccgatgcctcaggtgtcgccgatttcgtcgacaaacacgccgatgccgtcgatttccaccgctggctgcagtggcagctggacgagcagctcgccagtgcgcagtcgcaggcgctccgggccggcatgtcgctgggcatcatggcagacctcgccgttggcgtgcaccccaacggggccgacgcctgggctctgcaggacgtgctggcccaaggtgtgaccgcaggtgcgccgccggatgagttcaaccaactcggccaggactggtcgcagccaccgtggcggccggaccggctcgctgagcaggagtaccgaccgtttcgcgcgctgatccaggccgcgttgcggcacgccggtgcggtacgcatcgaccacatcatcgggctgttccggttgtggtggatccccgacggcgcaccgcccacccaaggcacctatgtgcgctacgaccacgacgcgatgatcggcatcgtcgccctggaagcccaccgggccggggcggttgtcgtcggtgaggatctcggcaccgtcgagccgtgggtacgcgactatctactattgcggggcctgctgggcacctcaattctctggtttgagcaggatcgagattgcgggccggctggaacaccattgccggccgaacgctggcgggagtactgcttgtcgtcggtgaccacccatgatctgccgccgaccgccggctacctggccggcgaccaggtacggctgcgcgagtcccttgggttgttaaccaaccccgtggaggcggaactcgaatccgcccgggccgaccgggcagcctggatggccgagctgcgccgggtcggactgctggcggacggtgccgagcccgactcggaggaggccgtcctggctctctaccgctacctgggccgaacgccctcgcggctgttggcagtggcgttgaccgatgcggtcggcgaccgccggacgcaaaaccagcctggcaccaccgacgagtacccgaactggcgggtgccgctcaccggccccgacggtcagccgatgctgctcgaggacatcttcaccgatcgcagggcagccaccttggccgaggcggtgcgcgctgcgacgacctcaccgatgagctgttggtga

SEQ ID NO: 260 - DNA, 204 bp, Mycobacterium Tuberculosis
gtgaaagtccgtctcgatccatcgagatgcgtgggtcatgcgcagtgctatgccgtcgatccggacctgttcccgatcgacgactcgggcaactcgatcctggcagagcacgaggtgcggcccgaggacatgcagctgaccagagacggtgtggccgcttgccccgaaatggcgctcatcctcgaggaggacgacgcggactga

SEQ ID NO: 261 - DNA, 348 bp, Mycobacterium Tuberculosis
atgaccgcttctgtcgtggctacttcccgtgaacgtcactcacacaaggccgcgaagcaacgagcttgcgaaataacggatttcgaaccggaaggccgattcagagtgcgaaaacggcgccggggtcggatcggaacgaaacggtcgtcgatctcggatacggactatcgccgggactcatttcgctctcacctcctcacggccggggcacacggggatgccgatgcacagcacaaagggatgacagcccagcagaccaccgaactcggcacccctctcgtcagagctttggcaccacacggcgtatccggccggtccagccggaagccacttgggctcaacccttaa

SEQ ID NO: 262 - DNA, 744 bp, Mycobacterium Tuberculosis
gtgagcgcacccgatagccccgcgctggccgggatgtcgatcggggcggtcctcgacctgctacgaccggattttcctgatgtcaccatctccaagattcgattcttggaggctgagggtctggtgacgccccggcgggcctcatcggggtatcggcggttcaccgcatacgactgcgcacggctgcgattcattctcactgcccagagggaccattacctgccgctgaaggtgatcagggcccagctggacgcccagcccgacggtgagttgccaccattcggatctccttacgttctaccgcgattggtgcccgtagccggcgacagtgctggcggcgtcgggtcggacaccgcgtccgtgtcgctcacgggtatccggctcagtcgggaagacctcctggaacgatcggaagtggccgacgagctactgacggccctgctcaaagccggtgtgatcaccaccgggccgggcggcttcttcgacgaacacgccgtcgtgatcctgcaatgcgcacgagcgctggccgaatacggcgtcgagccgcggcatctacgcgccttccgctccgcggccgaccggcagtccgacctgattgcccagattgccggcccgctcgtcaaggccggcaaggccggtgcccgcgaccgggccgacgacttggcccgtgaggtggccgcgcttgctataactttgcacacgtcgctgatcaagtctgcggttcgcgacgttcttcaccgctga

SEQ ID NO: 263 - DNA, 2034 bp, Mycobacterium Tuberculosis
atgggtaggcacagcaagcccgaccccgaggattccgttgacgacctgtccgacgggcatgcggcggaacaacagcactgggaggacatatcgggtagctacgactatcccggtgtagatcagcccgatgacggcccgttatccagcgagggccactactccgccgtcggcggctactcggctagcggctcagaagactaccctgacattccaccccgccccgactgggagccaacgggtgccgagcccatagcggccgccccgccgccgctgtttcgcttcggacatcgggggcccggcgactggcaggccgggcaccgtagcgcggacgggcggcggggagtcagtatcggcgtgatcgtggcccttgtcgcagtggtggtaatggtggccggggtgatcttgtggcgcttcttcggtgacgcgttgtccaaccgctcgcatacggctgccgcccgctgcgtgggcggcaaggacaccgtcgctgttatagccgacccatcaatcgccgatcaggtaaaggagtcagccgacagctacaacgcgtcggcgggcccggtcggcgaccgttgtgtggcagtggctgtcacctcggccggctccgatgccgtcatcaatggtttcatcggcaaatggccgaccgaactgggcggccagccgggattgtggattccgagtagctccatctcggcggcgcggcttaccggggccgcgggcagccaagccattagcgatagccgctcactggtgatatcgccggtgttgctcgccgtgcggcccgaattgcagcaggccctcgccaaccagaactgggcggcgttgcccggcctgcaaaccaatccgaactcgttgtccggcttggacttgcctgcctggggatcactgcggctggcaatgccgagcagtggcaacggcgatgccgcgtatttggccggcgaggcggtggctgccgcgtcagcacctgctggcgcgccagcaacagcgggtatcggcgcggtgcgcaccctgatgggcgcacgacctaagctcgccgacgactccttgaccgcggcgatggacacgctgctcaagcccggcgatgtcgccacggcacccgtgcacgcggtggtcaccaccgaacaacagttgttccagcgcggccagtcactttcagatgccgagaacaccttgggttcctggctgccgccggggccggctgcggtcgctgactatccgacggtgctgctcagtggtgcatggctatcgcaggagcaaacgtcggcggccagcgcgtttgccaggtatttgcacaagcccgagcaactggccaaactggccagagctggtttccgagtcagcgacgtcaaaccgccgagcagccccgtcaccagtttcccagcgctgccttcgactttgtcggtgggtgacgactccatgcgcgcgaccctggcggacaccatggtcaccgcgtcggccggagtggccgcgaccatcatgctcgaccaatcgatgcccaatgatgaaggcggcaatagccggcttagcaatgtcgttgcggcgcttgagaaccggatcaaggcgatgccgcccagttcggtcgtcggactgtggacattcgacggccgcgagggccgaacagaggtgccggccgggccattggccgacccggtcaacggccagccccgccccgcggccttgacggccgcgttgggcaagcaatactcctcgggcggtggcgcggtgtcgttcaccactctgcgcttgatctatcaggagatgctagccaattaccgtgttggccaggctaattctgtgctggttattaccgcggggccgcatacggaccaaaccctcgacgggccgggcctgcaggatttcatccgcaagagcgcagacccggccaagccgatcgcggtcaacatcatcgacttcggtgctgatcccgatcgggcaacctgggaagccgtcgcacagctcagcggcggcagctaccaaaacctggagacatcggcatcccccgacctggcaaccgcggtcaacatcttcttgagctga

SEQ ID NO: 264 - DNA, 2226 bp, Mycobacterium Tuberculosis
atgacagatcgcgtgtcggtgggcaacttgcgcatcgctcgggtgctctacgacttcgtgaacaatgaagccctgcctggcaccgatatcgacccggacagcttctgggcgggcgtcgacaaggtcgtcgccgacctgaccccgcagaaccaagctctgttgaacgcccgcgacgagctgcaggcgcagatcgacaagtggcaccggcgtcgggtgatcgagcccatcgacatggatgcctaccgccagttcctcaccgagatcggctacctgcttcccgaacctgatgacttcaccatcaccacgtccggtgtcgacgctgagatcaccacgaccgccggcccccagctggtggtgccggtgctcaacgcgcggtttgctctgaacgcggccaacgctcgctggggctccctctacgacgccttgtatggcaccgatgtcatccccgagaccgacggcgccgaaaaaggccccacgtacaacaaggttcgtggcgacaaggtgatcgcgtatgcccgcaagttcctcgacgacagtgttccgctgtcgtcgggttcctttggcgacgccaccggtttcacagtgcaggatggccagctcgtggttgccttgccggataagtccaccggcctggccaaccccggccagttcgccggctacaccggcgcagccgagtcgccgacatcggtgctgctaatcaatcacggtttgcacatcgagatcctgatcgatccggagtcgcaggtcggcaccaccgaccgggccggcgtcaaggacgtgatcctggaatccgcgatcaccacgatcatggacttcgaggactcggtggccgccgtggacgccgccgacaaggtgctgggttatcggaactggctcggcctgaacaagggcgacctggcagcagcggtagacaaggacggcaccgctttcctgcgggtgctcaatagggaccggaactacaccgcacccggcggtggccagttcacgctgcctggacgcagcctcatgttcgtccgcaacgtcggtcacttgatgacgaatgacgccatcgtcgacactgacggcagcgaggtgttcgaaggcatcatggatgccctattcaccggcctgatcgccatccacgggctaaaggccagcgacgtcaacgggccgctgatcaacagccgcaccggctccatctacatcgtcaagccgaagatgcacggtccggccgaggtggcgtttacctgcgaactgttcagccgggttgaagatgtgctggggttgccgcaaaacaccatgaagatcggcatcatggacgaggaacgccggaccacggtcaacctcaaggcgtgcatcaaagctgccgcggaccgcgtggtgttcatcaacaccgggttcctggaccgcaccggcgatgaaatccacacctcgatggaggccggcccgatggtgcgcaagggcaccatgaagagccagccgtggatcttggcctacgaggaccacaacgtcgatgccggcctggccgccgggttcagcggccgagcccaggtcggcaagggcatgtggacaatgaccgagctgatggccgacatggtcgagacaaaaatcgcccagccgcgcgccggggccagcaccgcctgggttccctctcccactgcggccaccctgcatgcgctgcactaccaccaggtcgacgtcgccgcggtgcaacaaggactggcggggaagcgtcgcgccaccatcgaacaattgctgaccattccgctggccaaggaattggcctgggctcccgacgagatccgcgaagaggtcgacaacaactgtcaatccatcctcggctacgtggttcgctgggttgatcaaggtgtcggctgctcgaaggtgcccgacatccacgacgtcgcgctcatggaggaccgggccacgctgcgaatctccagccaattgttggccaactggctgcgccacggtgtgatcaccagcgcggatgtgcgggccagcttggagcggatggcgccgttggtcgatcgacaaaacgcgggcgacgtggcataccgaccgatggcacccaacttcgacgacagtatcgccttcctggccgcgcaggagctgatcttgtccggggcccagcagcccaacggctacaccgagccgatcctgcaccgacgtcgtcgggagtttaaggcccgggccgctgagaagccggccccatcggacagggccggtgacgatgcggcccgctag

SEQ ID NO: 265 - DNA, 1440 bp, Mycobacterium Tuberculosis
gtgatgagatttctagacgggcacccacccgggtacgacctgacatacaacgacgtgttcatcgttccgaaccgatccgaggtcgcgtcgcgcttcgacgtcgatttgtccaccgccgacggctcgggcaccaccattccggtagtggtcgccaatatgaccgcggtagccgggcggcggatggccgagacggtcgcccgccgcggtggcatcgtaatcctgccgcaggatctgccgatcccggcggtaaagcagacggtggcgttcgtcaaaagccgggacctggtgctcgacaccccagtgacgctggcacccgacgattcggtgtccgacgccatggcgctcatccacaagcgcgcacatggcgtcgcggtggtcatcctcgagggtcgcccgatcggattggtgcgcgaatcgtcctgcctgggcgtggatcgcttcacccgggtgcgcgatatcgccgtgacggactatgtgaccgctccagcgggaaccgagccacgcaagatcttcgacctgctggagcacgccccggtcgacgttgcggtgctgaccgacgccgacggcacgttggcgggagtgctaagccgcaccggggctatccgcgccggtatctacaccccggccaccgatagcgcgggccggctgcggatcggcgcggccgtcggcatcaacggcgacgtgggcgctaaggcccgagcgctcgccgaagccggcgtcgacgtgctggtcatcgacaccgcacacggacaccaggtcaagaccttggacgcgatcaaggcggtctcggcactggacttgggtttgccgctggcggcgggaaacgtggtgtcggcggagggcacccgggatctgctgaaagccggggcgaacgtcgtcaaggtcggtgtcggccccggcgccatgtgcaccacccgaatgatgaccggtgtcggccgcccgcagttctccgctgtgctcgaatgcgcttctgcggcaaggcagctcggtggtcatatctgggccgacggcgggatccggcatccacgcgacgtggctctggcgctggccgccggcgcctcgaacgtgatgatcggatcgtggttcgccggcacctacgaatcccccggagacctgatgcgtgaccgcgacgatcagccgtacaaggagagctacggcatggcatccaagcgggcggtggtggcccggaccggcgcggacaacccgttcgaccgagctcgtaaggcgttgttcgaggaaggcatctcgacgtcgcggatgggccttgaccccgaccgcggaggtgtggaggacctaattgaccacatcacttctggcgtgcgcagcacctgcacctatgtgggtgcctcgaacctggcggagctgcatgagcgggccgtggtgggcgtgcagtcgggagcgggctttgccgagggccatccgctgcccgccggctggtga

SEQ ID NO: 266 - DNA, 786 bp, Mycobacterium Tuberculosis
gtgcgttggatcggactgtcaactggcctagtgtcagcgatgctggtcgcgggcctggtggcatgtggatcgaattcacccgcatcgtcgccagccgggccgacgcagggtgcccggtcgatcgtggtgttcgcggctgcctcgctgcagtctgcgttcactcagatcggtgagcagttcaaagccggcaacccaggggttaacgtcaacttcgctttcgctggttcttctgagttggccacccagctgacccagggcgcgaccgccgacgtctttgcatctgcggacaccgcgcaaatggacagtgtggccaaggcggggttgctggccggtcatccgacaaacttcgccaccaacacgatggtcatcgttgccgccgcaggcaatcccaagaagatccgatcttttgccgacctcacgcggccggggctcaacgtggtggtctgccagccgtcggtgccatgcggatcggcgacccggcgcatcgaagatgcaaccgggattcatctcaacccggtcagtgaggaacttagcgtgaccgacgttctgaacaaggtcatcaccgggcaagccgatgccgggctggtctatgtcagtgacgcgctcagcgttgccaccaaagtgacgtgtgtcagatttcccgaagccgcgggtgtggtcaatgtctacgccatcgcggtgctaaagcggacctcccagcccgctctggcccggcagttcgtggccatggtgaccgctgcggcaggtcggcggatcctggatcagtcgggtttcgccaagccctga

SEQ ID NO: 267 - DNA, 861 bp, Mycobacterium Tuberculosis
gtgccaggcaggacatccatcggcgtcaagatccgggacaaggtccaggacaaagtaatcgccatcaccggcggcgcccgggggatcggattggccacagcggccgcgctgcacaacttgggagccaaggtcgctatcggcgacatcgatgaggcgatggcgaaagagtcgggtgccgatctcgacctcgacatgtacggcaaactcgatgtcaccgacccggattcgttttcgggattcctcgacgccgtcgagcgccaactcggcccgatcgacgtgctggtcaacaacgccggcatcatgcccgtggggcggattgtcgacgaaccagacccggtaacccgccgaatcctggacatcaacgtctacggggtgatcttgggtagcaagctggcggcgcagcggatggtcccgcgcgggcggggacacgttatcaatgtcgcctcgcttgccggggaaatctacgccgtaggcgtggccacttactgtgccagcaagcacgcggtggtcgcgttcaccgattcggccaggcttgaataccgttcggccggcgtgaagttctcgatggtgttgccgtcgtttgtcaacaccgagctcattgcgggcaccggtgggatcaaaggattcaagaacgccgagccggccgatatcgccgacgcgatcgtcgggctgattgttcatcccaaaccgcgggtgcgggtcacgaaagcggctggctcgatgatcgtggcacagcggttcatgccgcgccaggtttccgagggcttgaaccgactcctcggcggcgagcatgtcttcaccgacgatgtcgacatggagaagcgcaggacctacgaggctcgggctcgcggcgaggagtga

SEQ ID NO: 268 - DNA, 390 bp, Mycobacterium Tuberculosis
ttgaatgcagctatgaatctcaagcgggaattcgtccatcgcgtgcaacggttcgtggtcaatccaatcggccggcaactgccgatgaccatgctcgaaaccatcggccgcaaaacgggacagccgcggcgtaccgcggtgggcgggcgcgtcgtagacaaccagttctggatggtgtccgagcacggcgagcattccgattacgtctacaacatcaaggccaaccccgccgtgcgggtccgcatcggcggccgatggcgcagtgggaccgcctacctgctacccgacgacgatccgaggcagcggctgcgcggcctaccccggctgaacagtgccggcgtacgcgcgatgggcaccgacttgctgaccatccgggtggatttggactga

SEQ ID NO: 269 - DNA, 834 bp, Mycobacterium Tuberculosis
atgaaagcgatattcatcaccggcgccggcagtggaatgggccgcgagggtgcaacgcttttccacgccaacggctggcgagtaggtgcgatagaccgcaatgaggatgggctggctgccctgcgcgtacagcttggtgccgaacggctgtgggcccgcgccgtcgacgttacggacaaggcggcccttgagggtgcgctcgctgatttctgcgccggcaatgtcggcggcggtctcgacatgatgtggaacaacgccggcatcggcgaaggcggttggttcgaggacgtgccgtacgaggccgccgtgcgcgtcgtcgacgtgaacttcaaggcggtgctcactggcgcctacgccgcactgccttacctcaagaaagcaccgggaagtctgatgttctcgacgtcgtcgtcctcgggcacctatggcatgccgcgtatcgcggtctactcggcgaccaaacacgccgtcaaggggttgaccgaggcgttgagcgttgagtggcagcgtcatggggttcgcgtcgccgacgtgctgcccggtctgatcgacaccgctatcctcacctcgacgcgccagcattccgacgagggcccctacacgatctccgcggagcagatccgcgctgccgcgcccaagaagggcatgttccggctgatgccctcgtccagcgtcgccgaggcagcctggcgggcctaccagcaccccacacggttgcattggtatgtgccccgaagcattcgctggattgatcggctcaagggcgtcagtccggagttcgtccgacgtcacattgccaagtccctggccacgttggagccaaaacggaagtaa

SEQ ID NO: 270 - DNA, 978 bp, Mycobacterium Tuberculosis
atgacagacgtgagccgaaagattcgagcttggggacgccgattgatgatcggcacggcagcggctgtagtccttccgggcctggtggggcttgccggcggagcggcaaccgcgggcgcgttctcccggccggggctgccggtcgagtacctgcaggtgccgtcgccgtcgatgggccgcgacatcaaggttcagttccagagcggtgggaacaactcacctgcggtttatctgctcgacggcctgcgcgcccaagacgactacaacggctgggatatcaacaccccggcgttcgagtggtactaccagtcgggactgtcgatagtcatgccggtcggcgggcagtccagcttctacagcgactggtacagcccggcctgcggtaaggctggctgccagacttacaagtgggaaaccttcctgaccagcgagctgccgcaatggttgtccgccaacagggccgtgaagcccaccggcagcgctgcaatcggcttgtcgatggccggctcgtcggcaatgatcttggccgcctaccacccccagcagttcatctacgccggctcgctgtcggccctgctggacccctctcaggggatggggcctagcctgatcggcctcgcgatgggtgacgccggcggttacaaggccgcagacatgtggggtccctcgagtgacccggcatgggagcgcaacgaccctacgcagcagatccccaagctggtcgcaaacaacacccggctatgggtttattgcgggaacggcaccccgaacgagttgggcggtgccaacatacccgccgagttcttggagaacttcgttcgtagcagcaacctgaagttccaggatgcgtacaacgccgcgggcgggcacaacgccgtgttcaacttcccgcccaacggcacgcacagctgggagtactggggcgctcagctcaacgccatgaagggtgacctgcagagttcgttaggcgccggctga

SEQ ID NO: 271 - DNA, 432 bp, Mycobacterium Tuberculosis
gtgcgggttctggtgcaacgggtctcatcggctgcggtgagggtcgatggtcgggtggtcggcgctatccggccggacgggcagggcctggtcgcgttcgtcggtgtcacccacggcgacgatctcgacaaggcgcgccgtctcgccgaaaagctctggaatttgcgggttctcgccgacgagaaatccgcctccgacatgcacgcaccgatcctggtaatcagccagttcaccctctacgcagacaccgcgaagggtcggcgaccgtcctggaacgccgcggcgccaggtgcggtggcgcagcccctgatagcagcgttcgcggcagcgctgcgccagttgggagcgcacgtggaagccggcgtgttcggtgcccacatgcaggtcgaactggtcaacgacggtccggtgaccgtaatgctggaaggctga

SEQ ID NO: 272 - DNA, 1293 bp, Mycobacterium Tuberculosis
atggcggtgagcgcacgtgcgggcatcgtgatcaccggaaccgaggtcctgaccgggcgggtccaagaccgcaacggcccctggatcgccgatcggctcctggagctcggggtcgagttggcacacatcacgatctgcggcgaccgtcccgccgacatcgaggcacagctgcgattcatggctgagcagggtgtggacctgatcgtcaccagcggcggcctggggccgaccgccgacgatatgaccgtcgaggtggtggcgcgctattgcgggcgcgagctggtgctggacgacgagctggagaacaggatcgccaacatcctcaagaagctgatggggcgaaatcccgctattgaacccgccaacttcgactccatacgcgccgccaaccgcaaacaggccatgattccggccggatcgcaagtgatcgatccggtgggcaccgcccccggtctggttgtgccgggacggccagcggtgatggtgcttcccgggccaccgcgcgagctgcagccgatatggagcaaggccatccagacggctccggtacaggatgcgattgccggccggacgacctaccgacaggagaccatccggatcttcggcctgccggagtcttctctggccgacacactgcgtgacgccgaggcagccatcccgggttttgacttagtcgagatcaccacctgcctgcggcgcggcgagattgaaatggtcactcgctttgaaccgaacgccgcgcaagtgtacacgcaattggcacggttattgcgcgaccggcacggccaccaggtctattcggaagacggtgcgtccgtggacgagctggtcgcaaaattgctaactggccgccggatagcgaccgccgaatcctgcaccgcagggttgctggcggcacggctcaccgaccggcccgggtcgtccaagtacgtggcgggcgcagtggtggcctactctaacgaggcgaaggcacagcttctcggtgtggatccggcgctgatcgaggcccacggggcggtttccgagccggtcgcccaggcaatggcagcgggggcgctgcaaggcttcggcgccgacaccgccaccgcgatcaccggaattgcgggtccgagtgggggaacgccggaaaagcctgtgggaacagtgtgcttcaccgtcctgctggacgatggccgaacaaccacccgaaccgtgcggctgcccgggaaccggtcagacattagggagcgctcgacgactgtggcgatgcacctgctgcggcgcaccctgagcggtatcccgggctcaccctag

SEQ ID NO: 273 - DNA, 471 bp, Mycobacterium Tuberculosis
atgcgcttgaagccagccccatctcctgctgcagcctttgccgtcgccggcctgatcctcgcaggctgggccggatccgtgggcctcgccggcgccgatccggagccggcaccgacaccgaagacggcaattgatagcgacggcacctatgcggtggggattgacatcgctcccggcacgtacagctccgcgggacccgtcggcgacggcacctgctattggaagcggatgggtaaccccgatggcgcgctcatcgataacgcactcagcaagaaaccacaggtagtgacgattgagccgaccgacaaggcgttcaagacgcacggctgccaaccctggcagaacacgggcagcgaaggcgctgcccctgccggagttcctggacctgaagcgggggcccaactacaaaatcagctcggcatcctcaacggcttactcggaccgactggagggcgagtgcctcagccctaa

SEQ ID NO: 274 - DNA, 1197 bp, Mycobacterium Tuberculosis
atgacctacggagaggccgtggcggacgtgctcgaattcggtcagagcgagggcgaacccattggcatggctcccgaggagtggcgggcgttcgccgcgcgtgcatcgctgcatgccgcccgggcaaaggccaaggagctgggcgccgatccgccatgggactgcgagctggccaagaccccggagggctactaccagatccgcggcggcataccgtatgcgatcgccaaatcgctggccgcggcaccgtttgccgacattctttggatggagaccaagaccgccgatctcgccgacgctcgacagttcgccgaggcgatccatgccgagttccccgaccagatgctggcgtacaacctctcaccatcgttcaactgggacaccaccggcatgaccgacgaggagatgcggcgcttccccgaggagctcggcaaaatgggcttcgtcttcaacttcatcacctatggcgggcaccagatcgacggtgtcgcggccgaggaattcgccaccgcgctgcgccaggacggcatgctggcgctggctcggttgcagcgcaagatgcgcttggtcgaatctccctatcgcacaccgcaaacgctagtcggcgggccgcgcagtgacgccgcattggctgcctcctccggacgcacggcgaccacgaaggcaatgggcaagggctccacccagcaccagcacttggtgcaaactgaggtgccgcgcaagctgctagaggaatggctggccatgtggagcggtcactaccagctcaaagacaaactgcgcgtacagcttcggccgcagcgggccggctcggaggtgctcgagctcggcatccacggcgaaagcgatgacaagctcgccaacgtgatattccaaccgatccaagatcgccgcggccgcaccatcctgttggtacgcgaccagaacacgttcggtgcggaactacgccaaaagcggctgatgaccctgatccacctctggctcgtccaccgcttcaaggcgcaggcggtgcactacgtcacgcccaccgacgacaacctctaccagacctcgaagatgaagtcgcatggaatcttcaccgaggtcaaccaggaggtgggcgagatcatcgtcgccgaggtgaaccacccgcgcatcgccgaactgctgacgcccgatcgggtggcgctgcggaagttgatcacgaaggaggcgtag

SEQ ID NO: 275 - DNA, 480 bp, Mycobacterium Tuberculosis
atgaagctcaccacaatgatcaagacggcagtagcggtcgtggccatggcggccatcgcgacctttgcggcaccggtcgcgttggctgcctatcccatcaccggaaaacttggcagtgagctaacgatgaccgacaccgttggccaagtcgtgctcggctggaaggtcagtgatctcaaatccagcacggcagtcatccccggctatccggtggccggccaggtctgggaggccactgccacggtcaatgcgattcgcggcagcgtcacgcccgcggtctcgcagttcaatgcccgcaccgccgacggcatcaactaccgggtgctgtggcaagccgcgggccccgacaccattagcggagccactatcccccaaggcgaacaatcgaccggcaaaatctacttcgatgtcaccggcccatcgccaaccatcgtcgcgatgaacaacggcatggaggatctgctgatttgggagccgtag

SEQ ID NO: 276 - DNA, 1110 bp, Mycobacterium Tuberculosis
atggagatcggaatattcctcatgccggcccatccaccggagcgcaccctctacgacgccacccggtgggatctggacgtcatcgagctggccgatcaactcggctacgtggaggcctgggtcggcgaacacttcaccgtgccgtgggagccgatctgcgcccccgatctgctgttggcgcaggcgctgctgcgcacccaacagatcaagctcgccccgggtgcgcacttgttgccctaccatcatccggtcgagttggcccaccgggtggcctatttcgaccacctcgcccagggtcggttcatgctcggcgtgggcgccagcggcatcccgggtgactgggcgctgtatgacgtggacggcaagaacggcgagcatcgcgaaatgacccgggaagcgctggagatcatgctgcgcatctggaccgaggacgagccctgggagcatcgcggaaagtactggaacgccaacggaatcgcgccgatgttcgagggtctgatgaggcgccacatcaagccgtaccagaagccccacccgcccatcggcgtcaccgggttcagcgccggctcggagaccctcaagctcgccggcgaacggggttacatccccatgagtctggacctcaacaccgaatacgtcgccacccactgggacgcggtggaggaaggcgcgctgcgcagcgggcgaaccccggatcgccgcgattggcggctggtgcgggaggtgctggtggccgagaccgatgagcaggcgttccggtatgccgtggacggcacgatgggacgcgccatgcgtgagtatgtgctgccgacgtttcggatgttcggcatgaccaagttctacaaacacaatccgtcggtgcccgacgacgaggtgacaccggagtatctcgccgagaacaccttcgtggtcggctcggtgcagaccgtggtcgacaagctcgaggccacctacgaccaggtcggcgggttcggccacctgctgatcctcgggttcgactacagcgataacccgggcccgtggaaggagtcgttgcggctgctggcccacgaggtcatgcccagactcaacgcccgcctcgccaccaagcccgccaccgcggtggtgtag

SEQ ID NO: 277 - DNA, 1365 bp, Mycobacterium Tuberculosis
atgaggtcggacacgcgcgaggagatctccgcggcgttggatgcctaccacgcctcgttgtcgcgggtgctcgatctcaagtgcgatgcgttgaccaccccggaattgctggcctgtttgcagcgactcgaggtcgaacggcgccgccagggcgccgccgagcacgccttgatcaaccaactcgctgggcaagcctgcgaggaagagctcggcgggacgctgcgcacggcgttggccaaccggctacacatcactcccggtgaggccagccgccgcatcgccgaagccgaagacctcggtgagcgccgcgccctgaccggtgaaccgctgccagcgcagttgaccgcgaccgcggccgctcaacgtgagggcaagatcggccgagaacacattaaggagatccaggccttcttcaaggagttgtccgccgcggtggatctgggtatccgcgaggccgccgaggcccagctggccgaactggccaccagtcggcgtcccgatcacctgcatggcctggccacgcagctgatggactggctgcaccccgacggcaacttttccgaccaggagcgtgcccgcaagcgcggcatcacgatgggtaagcaggaatttgacgggatgtcacgtatcagcggtctgctgaccccggagttgcgggccaccatcgaggcggtgttggccaaactggccgcaccgggggcgtgcaaccccgatgaccagaccccggtcgtggatgacacaccggatgcggacgcggtgcgccgcgacacccgcagccaagcccaacgacaccatgacggtttactggccgggctgcgcgggttgttggcctccggtgagctagggcagcatcgggggttgccggtgaccgtcgtggtgagcaccacgcttaaagagctggaagccgccaccggcaagggggtaaccggtggtggttcgcgggtgccgatgtcggaccttatccggatggcgagcaacgcgcaccactatctggcattgtttgacggcgctaagccgttggcgttgtatcacaccaagcggttagcttccccggcgcagcgaatcatgttgtacgccaaggatcgtggctgctccaggccgggttgcgacgccccggcctaccacagtgaggtccaccacgtaacgccgtggacaaccacccaccgtaccgacatcaacgacctcacgctggcctgcggccccgacaatcgccttgtcgaaaaaggctggaaaacccgcaagaacgccaaaggcgacactgaatggctaccgccggcccacttggaccatggccaaccacgcatcaatcgataccaccaccccgagaaaatcctgtgcgaacccgacgacgacgaaccacattga

SEQ ID NO: 278 - DNA, 513 bp, Mycobacterium Tuberculosis
gtgccgtcgggatgggtgtcgcaccgtctcggcgggtcgcccaagtgcataagtgctttgtcgctgccctccggtaccgtcggagccccgtccaagccggacaacgacgccactcgaggcaggacaagaccaactgtgccgccccctgatccagccgccatgggtacctggaagttcttccgggcatctgtggatggccggccggtattcaagaaggagttcgacaagcttcctgatcaggcccgggccgcgctgatcgtgctaatgcagcggtatctcgtcggcgacctcgccgcagggagcatcaaaccgattcgtggcgacattctggagttgcgatggcatgaggcgaacaaccacttccgggtactgttcttccgctggggccagcatcccgtagcgctgacagcgttctacaagaaccagcagaagactcccaagacgaagatcgagacggccctggaccggcagaaaatctggaaaagagccttcggcgacaccccaccgatctga

SEQ ID NO: 279 - DNA, 1314 bp, Mycobacterium Tuberculosis
atgctgcatctaccgcgccgagtgatcgttcagctggccgtctttaccgtgatcgcggtgggcgtgctggccatcacgttcctgcatttcgtgaggctgccggcgatgcttttcggcgtcggccgctacacggtgacgatggagctggtcgaagccggtgggctgtatcgcaccggcaatgtcacctaccgcggctttgaggtgggccgggtggcagcggtgcggctcaccgacaccggggtgcaagcggtgctggccctgaaatcgggcatcgatatcccgtcggacctcaaggccgaggtgcacagccacaccgcgatcggcgaaacctacgtcgagttgttgccgcgcaacgccgcctcgccgccactgaagaacggcgatgtcattgcgctggccgacacctcggtgccgcccgacatcaacgacctgctcagcgcggccaacaccgcattggaggcaatacctcacgagaacctgcagaccgtcatcgacgagtcgtacaccgcggtggccgggttagggctcgaactttcccggctgatcaagggctcggcggaactggcgatcgatgctcgcgcgaatctcgatccgctggtggcgctgatcgaccgggcaggaccggtgctggattcgcagacccacacctcggatgcgatcgcggcctgggcggcacagctggccgcagtcaccggccaattgcagacacacgactcggcggtcggcgatctcatcgaccggggcggtccggcgttgggggagacgcgccaactgctcgagcggctacaacccaccgtgcccatcctgctggccaacctggtcagcgtcggccaggtcgcactcacctatcacaacgacatcgaacagctgctggtggtgttccccatggccatcgccgccgaacaggccggcatcctggccaacctcaacaccaagcaggcctaccggggccagtatctgagcttcaacctcaacctgaacctgccgccgccgtgcaccaccggctttctgccggcccagcagcggcgcattcccacgttcgaggactacccggatcgcccggccggtgatctgtactgccgggtgccccaggattcgccgtttaacgtgcgcggcgcccgcaacatcccctgtgaaaccgtgccgggcaagcgcgcacccaccgtgaagttatgcgagagcgacgcgccatacctgccgctgaacgacggctacaactggaagggcgaccccaacgccacggtgccgggtttggggtccggccaggacatcccgcagacatggcaaacgatgctgctgccgccgggcagctga

SEQ ID NO: 280 - DNA, 378 bp, Mycobacterium Tuberculosis
gtgcagcgccaatcattgatgccccagcagacccttgccgccggcgttttcgtgggtgcgctgctatgcggtgtcgtgacggcggcggtgccaccacacgcacgcgccgacgtggtcgcctatctggtcaacgtgacggtacgcccgggctacaacttcgccaacgccgacgccgcgttgagttacggacatggcctctgcgagaaggtgtctcggggccgcccttacgcacagatcatcgccgacgtcaaggctgatttcgacacccgcgaccaataccaggcctcgtatctgctcagccaggctgtcaacgaactctgccccgcgctgatctggcagttgcgaaactccgcagtcgacaatcggcgctcgggctga

SEQ ID NO: 281 - DNA, 687 bp, Mycobacterium Tuberculosis
gtgcgcatcaagatcttcatgctggtcacggctgtcgttttgctctgttgttcgggtgtggccacggccgcgcccaagacctactgcgaggagttgaaaggcaccgataccggccaggcgtgccagattcaaatgtccgacccggcctacaacatcaacatcagcctgcccagttactaccccgaccagaagtcgctggaaaattacatcgcccagacgcgcgacaagttcctcagcgcggccacatcgtccactccacgcgaagccccctacgaattgaatatcacctcggccacataccagtccgcgataccgccgcgtggtacgcaggccgtggtgctcaaggtctaccagaacgccggcggcacgcacccaacgaccacgtacaaggccttcgattgggaccaggcctatcgcaagccaatcacctatgacacgctgtggcaggctgacaccgatccgctgccagtcgtcttccccattgtgcaaggtgaactgagcaagcagaccggacaacaggtatcgatagcgccgaatgccggcttggacccggtgaattatcagaacttcgcagtcacgaacgacggggtgattttcttcttcaacccgggggagttgctgcccgaagcagccggcccaacccaggtattggtcccacgttccgcgatcgactcgatgctggcctag

SEQ ID NO: 282 - DNA, 345 bp, Mycobacterium Tuberculosis
gtggtgattagtcgtgccgagatctactgggctgacctcgggccgccatcaggcagtcagccggcgaagcgccgcccggtgctcgtaatccagtcagatccgtacaacgcaagtcgccttgccactgtgatcgcagcggtgatcacgtccaatacggcgctggcggcaatgcccggcaacgtgttcttgcccgcgaccacaacgcgactgccacgtgactcggtcgtcaacgtcacggcgattgtcacgctcaacaagactgacctcaccgaccgagttggggaggtgccagcgagcttgatgcacgaggttgaccgaggacttcgtcgcgtactggacctttga

SEQ ID NO: 283 - DNA, 1326 bp, Mycobacterium Tuberculosis
atggacgagatcgagagccttatcgggctgcggccaaccccgctgacctggccggtcgttatcgccggcgactttctaggcgtgtgggacccaccaccgagtctcccgggggcggctaaccatgaaatatcagcgcctaccgctagaatttcatgcatgttgatcgaacgccgcgacgccgccgcgcggttgcgacgcgcgctacaccgagcgccggtggtgttgcttaccggacctcgtcaagccggcaagaccacccttagccggctggtgggcaagtccgcacccgaatgtacgtttgacgccgaaaatcccgtcgacgcgacacggcttgccgacccgatgttggctttatccggccttagcgggttgatcacgatcgacgaggcgcaacggattccggatctgtttccggtcctacgcgtgctcgtcgacaggcctgtcatgccggcccggtttcttatcctgggtagcgcctcacccgatcttgtcgggctggcgtccgaaagtttggccggacgcgtcgagttggtggagttgtccggcctgacggtccgcgacgtcggatcctcggccgccgatcgcctctggttgcgtgggggtctaccgccctcgttcacggcacgctccaacgaggactccgcggcgtggcgcgacggctacatcaccacgtttctggagcgcgatctcgcccagcttggtgtgcgcattccggccgcgacgatgcggcgcgcgtggacgatgctcgcccactaccatggccagctcttcagcggcgcagaacttgcccgctcactcgacgttgctcagacgacggcgcggcgatacctcgatgcgctcaccgatgcactcgtcgtccgtcagctgacgccctggttcgccaacatcggaaagcgacaacgccgatcacccaagatctacatccgggacaccggtttgttgcacaggttgctcggtatcgacgatcggcttgccctcgaacgcaatccgaagctcggcgcgagctgggaggggttcgtgctcgagcagcttgcggccctgctcgccccgaatccgctgtattactggcgcacccagcaagacgccgaactcgatctctatgtcgaattatctggccgtccctatggattcgagatcaagcggacgtctacaccgtcgatttcccggtcgatgcgctcggctcttgtcgacctccaactggcgaggttggcaatcgtctaccctggcgaacaccgctttcccttgagcgacacggtcgttgcggttcccgcggatcagatcttgaccaccgggagtgtcgatgaacttctcgcgctcttgaaatga

SEQ ID NO: 284 - DNA, 435 bp, Mycobacterium Tuberculosis
atggccaccacccttcccgttcagcgccacccgcggtccctcttccccgagttttctgagctgttcgcggccttcccgtcattcgccggactccggcccaccttcgacacccggttgatgcggctggaagacgagatgaaagaggggcgctacgaggtacgcgcggagcttcccggggtcgaccccgacaaggacgtcgacattatggtccgcgatggtcagctgaccatcaaggccgagcgcaccgagcagaaggacttcgacggtcgctcggaattcgcgtacggttccttcgttcgcacggtgtcgctgccggtaggtgctgacgaggacgacattaaggccacctacgacaagggcattcttactgtgtcggtggcggtttcggaagggaagccaaccgaaaagcacattcagatccggtccaccaactga

SEQ ID NO: 285 - DNA, 996 bp, Mycobacterium Tuberculosis
atgccggacaccatggtgaccaccgatgtcatcaagagcgcggtgcagttggcctgccgcgcaccgtcgctccacaacagccagccctggcgctggatagccgaggaccacacggttgcgctgttcctcgacaaggatcgggtgctttacgcgaccgaccactccggccgggaagcgctgctggggtgcggcgccgtactcgaccactttcgggtggcgatggcggccgcgggtaccaccgccaatgtggaacggtttcccaaccccaacgatcctttgcatctggcgtcaattgacttcagcccggccgatttcgtcaccgagggccaccgtctaagggcggatgcgatcctactgcgccgtaccgaccggctgcctttcgccgagccgccggattgggacttggtggagtcgcagttgcgcacgaccgtcaccgccgacacggtgcgcatcgacgtcatcgccgacgatatgcgtcccgaactggcggcggcgtccaaactcaccgaatcgctgcggctctacgattcgtcgtatcatgccgaactcttttggtggacaggggcttttgagacttctgagggcataccgcacagttcattggtatcggcggccgaaagtgaccgggtcaccttcggacgcgacttcccggtcgtcgccaacaccgataggcgcccggagtttggccacgaccgctctaaggtcctggtgctctccacctacgacaacgaacgcgccagcctactgcgctgcggcgagatgctttccgccgtattgcttgacgccaccatggctgggcttgccacctgcacgctgacccacatcaccgaactgcacgccagccgagacctggtcgcagcgctgattgggcagcccgcaactccgcaagccttggttcgcgtcggtctggccccggagatggaagagccgccaccggcaacgcctcggcgaccaatcgatgaagtgtttcacgttcgggctaaggatcaccggtag

SEQ ID NO: 286 - DNA, 1320 bp, Mycobacterium Tuberculosis
atggtcaataagccgttcgagcggcgcagtctgttacggggtgcgggcgcgcttactgcggcctcgctggctccctgggccgctgggtgtgctgccgatgacgatgacgcgttgactttcttttttgcagccaatccggacgagctccgtccccggatgcgcgtcgtcaacgaattccagcggcgctatcccgatatcaaggtacgggccctgttgtccggacccggcgtcatgcagcagctcgcaacgttttgcgcgggtggcaagtgtccggatgtgctgatggcatgggaactgacctatgccgaactggccgaccggggggtgttgcttgacctgaacacgctattggcgcgcgaccaggctttcgccgcggagctgaaatcggacagcatcggggccctgtatgagactttcacgttcaacggaggccagtacgcctttccggagcaatggtccggcaacttcttgttctacaacaaacagctattcgacgacgccggcgtgccaccgccgcccggtagctgggaacggccatggagcttcgccgaattcctggatgccgcccaggcgcttaccaagcagggccggtcgggacgggacaggcaatggggcttcgtcaacgcgtgggtctcgttctacgctgccgggttgttcgccatgaataacggtgtaccgtggtcggttccgcggatgaatcccacccacctcaatttcgaccacgatgggttcctcgaagcggtgcagttctacgccgacctgaccaacaagcacaaggtggcccccagcgctgctgagcagcagtcgatgtcgacggcggacctgttttctgtgggcaaggccgggatcgcgttggccgggcactggcgatatcagacgttcgaccgtgccgacggtctggacttcgacgtcgccccactgcccatcggtccgcgcggacgagccgcctgttcagatatcggtgtcaccgggctggccattgcggcgaccagtcgacgcaaggaccaggcgtgggaattcgtaaagttcgcgaccggcccggtggggcaggcattgatcggcgaatcccgcctgttcgtgccggtgctgagatcggcgatcaactcgcacggattcgccaacgcccaccgcagggtaggcaatcttgccgtgctcagcgaggggccggcctattcggaaggcttgccggtgaccccggcctgggagaagatcgccgccctgatggaccgctacttcggacccgtgctgcgtggatcccggccggcgacctcgctgaccgggctatcacaggccgtcgatgaagtgctgcgcaatccatga

SEQ ID NO: 287 - DNA, 12456 bp, Mycobacterium Tuberculosis
atggttgatcaactccagcatgcgaccgaagcgctgcgcaaagcgctggtccaggtggaacgcctgaagcgcaccaaccgtgcgttgctggagcgctcgagcgagccgatcgcgatcgtgggcatgtcgtgtcgcttcccggggggcgtcgattccccggaagggctgtggcagatggtggccgacgccagggacgtgatgtcagaatttcccaccgaccgtgggtgggatctggccgggttgttcgacccggatcccgacgtgcgccataagtcgtacgcgcgcactgggggcttcgtggatggcgtcgcggatttcgatcccgcgttcttcggtatttcgcccagcgaggcgttagcgatggatccacagcatcggatgttgctggagttgtcctgggaggcgttggagcgggccggtatcgatccgaccggattgcgcggcagcgccaccggggtattcgccgggctcatcgtcggcggctacggaatgttggccgaggagatcgagggctaccggctgaccgggatgacctccagcgtcgcctcgggtcgggtggcctatgtgctggggttggagggtccggcggtgtcggtggatacggcgtgttcgtcgtcgttggtggcgttgcatatggcggtgggatcgctgcggtcgggggagtgcgatctggcgctggctggcggcgtcaccgtcaacgccacaccgacggtcttcgtggaattcagcaggcatcgtgggctggcacccgacggccggtgcaagccttacgccgggcgggctgatggggtcggctggtccgagggcggtgggatgttggtgctgcagcggctttcggatgcgcggcggttgggtcatccggtgttggcggtggtggtcgggtcggcggttaatcaggatggggcgtcgaatgggttgaccgcgcctaatggtccttcgcagcagcgggtggtgcgggcggcgttggccaatgccgggttgagcgcggccgaggtggatgtggtggaggggcatgggaccgggaccacgttgggggatccgattgaggctcaggcgttgttggccacttatgggcaagatcggggggagccgggagaacctttgtggttggggtcggtgaagtcgaatatgggtcatacgcaggccgcggcgggggtggccggggtgatcaagatggtgttggcgatgcgccatgagctgttgccggcgacgttgcacgtggatgtgcctagcccgcatgtggattggtcggcgggggcggtggagttgttgaccgcgccgcgggtgtggcctgctggtgctcggacgcgtcgtgcgggggtgtcgtcgtttgggattagtggcactaatgcgcatgtgattatcgaggcggtgccggtggtgccgcggcgggaggctggttgggcggggccggtggtgccgtgggtggtgtcggcgaagtcggagtcggcgttgcgggggcaggcggctcggttggccgcgtacgtgcgtggcgatgatggcctcgatgttgccgatgtggggtggtcgttggcgggtcgttcggtttttgagcatcgggcggtggtggttggcggggaccgtgatcggttgttggccgggctcgatgagctggcgggtgaccagttgggcggctcggttgttcggggcacggcgactgcggcgggtaagacggtgttcgtcttccccggccaaggctcccaatggctgggcatgggaatcgaactgctcgataccgcaccggcattcgcgcagcagatcgacgcgtgtgccgaggcgttcgcggaatttgtcgactggtcgctggtggacgtgctgcgtggcgcccccggtgcaccgggactggatcgcgtggatgtggtgcagcccgtgctgttcgcggtgatggtgtcactggccgagctgtggaagtcggtcgcagtgcatccggatgcggtgatcggtcattcgcaaggcgagatcgctgccgcctacgttgccggcgcgctgtcgctgcgcgacgccgcacgggtggtcacgctgcgcagcaagttgctggccggactggccggcccgggcggcatggtgtccatcgcgtgcggtgccgaccaggcgcgggatttgttggcgcccttcggcgatcgggtcagcatcgccgtcgtcaacggcccctcggcggtggtggtgtcgggcgaagtgggcgcgctggaggagctgatcgcggtgtgctccaccaaggaactgcggacccgccggatcgaggtggactatgcctcgcattcggtggaggtcgaggcgatccgtggcccactcgccgaagctctgtccggcatcgaaccgcgatccacgcgtaccgtcttcttctctacggtgaccggaaatcgtttggatacagctggtttggacgccgactactggtaccgcaacgtccgccagaccgtgctattcgaccaggcggtgcgcaacgcctgcgagcagggctaccgcacgttcatcgaatccagcccgcatccggcgttgattaccggtgtcgaggaaacattcgccgcgtgcaccgacggtgacagcgaggccattgtcgtccccacgctggggcgtggagatggtgggctgcaccgattcctgctctcggcggcgtccgcgtttgtggcgggggtggctgtgaactggcggggcacgctggacggagcgggctatgtggagctgccgacgtatgcctttgacaagcgccggttttggctctcggccgagggctcaggcgccgacgtatccggtttggggttgggtgcgagcgaacacccgttgctgggcgcggtggtcgacctgcccgcctccggcggggtggtgttgacgggtcggttgtcgcccaacgtgcagccgtggttggccgaccacgccgtttcagacgtggtgctgttcccgggcaccggattcgtggagctggcgatccgcgccggcgacgaagtcggctgctcggtgcttgacgagctgacgctggccgcacccctgctgttgcccgccaccggctccgttgcggtgcaggtggtagtcgacgctggccgggattcgaattcccgtggtgtgtcgatattttcccgagctgacgcgcaagcgggctggcttttgcatgccgagggtatcctgcggcccgggtcggttgaaccaggcgcggacctatcggtgtggccaccggcaggtgccgtgacggtggacgtggccgatggctatgagcggttggcgacacgcggctaccggtacggaccggcgtttcgcgggctgaccgcgatgtgggcccgcggcgaggaaatattcgccgaggtgaggctgccggaggcggccgggggagtcggtgggttcggtgtgcatccggctttgttggacgccgtcttgcatgcggtcgtgatcgccggcgacccggacgaactcgcattgccgttcgcttggcagggcgtgtcgttgcatgccacgggggcctcggcggtgcgggcccggatcgcgccggcggggccgtcggcggtgtcggtggagttggcggacgggctgggtctgccggtattgtcggtggcctcgatggtggcccgcccggtgaccgagcggcagctgctggcggcggtgtcgggctcgggtcccgaccggctgttcgaagtgatctggtcgcccgcgtcggcggccacgtccccggggcctacccccgcctaccagatctttgaatcggttgcggctgaccaagatccggtagccggcagctacgtgcgcagccaccaggctctggccgcagtgcagtcgtggctgaccgaccatgaatccggggtgctggtggtggcgacccggggcgcgatggcgctgccccgcgaagacgtcgccgatctggcgggcgcggccgtgtgggggctggtgcggtcggcgcagaccgagcatccgggccggatcgtgctggtcgattccgatgcggccaccgacgacgcggcgatcgcgatggcgttggcgactggcgagccgcaggtagtgctgcggggcggacaggtgtacaccgcgcgcgtgcgcggcagccgcgcggcggatgccatcttggtgccgccgggcgatgggccatggcggttgggtctgggcagcgcgggcaccttcgaaaatctgcggctcgagccggttcccaacgccgacgcaccgttggggcccggccaggtccgggtggccatgcgcgccatcgccgcgaacttccgcgacatcatgatcaccctaggcatgttcacccacgacgcgctgctcggcggcgaaggcgcgggcgtggtcgtcgaggtcggccccggtgtcaccgaattctcggtcggtgattcggtgttcggattcttccccgacggcagcggcaccctggtggccggcgacgtccggctgctgctgccgatgcccgccgactggtcctacgccgaagccgccgccatctcggctgtcttcaccaccgcgtactacgcattcatacatttggccgacgtacaaccgggccagcgcgtgttgatccatgccggcaccggcggggtgggcatggcggcggtgcagctggctcggcatctggggttggaggtgttcgcgaccgcgagcaagggtaagtgggacaccttgcgcgccatgggctttgacgacgaccacatatccgattcacgtagcctagagttcgaggacaagttccgcgcggccactggcggtcgagggttcgacgtggtgttggactcgctggccggtgaattcgtggatgcgtcgctgcgtctggtggcaccgggtggggtgttcttggagatgggcaagaccgacatccgcgaccccggcgtgatcgcccagcagtacccgggcgtgcgctaccgcgccttcgacctattcgaaccgggacgtccccggatgcatcagtacatgctggagctcgccacgctgttcggcgatggggtgctgcggccgttgccggtcaccacttttgacgtgcggcgcgcgcctgcggcgttgcgttatctgagccaggcgcgccacaccggcaaggtcgtcatgctgatgcccggctcgtgggcggcgggcacggtgttgatcaccggtggcaccgggatggcgggttcggcggtggcccgtcacgtggtggctcgtcatggggtgcgcaatctggtgttggtgagccggcgcggcccggatgctcccggggctgcggagctggtggccgagttggccgccgccggtgcgcaggtacaggtggtggcctgtgacgcggcggatcgagcggcgttggccaaggtgatcgccgatattccggttcagcatccattgtcgggcgtgatccacaccgccggcgcactcgacgacgcggtggtgatgtcactgacaccggatcgggtggatgtggtgttgcggtccaaggtggacgcggcgtggcacctgcacgagttgactcgcgacctggatgtgtcggcgtttgtcatgttttcgtcgatggccgggctggtcggatcgtcgggccaggccaactatgcggccgccaattcgtttttggatgcgctggccgcccaccggcgggcccatgggctgccggccatctccctgggctggggtctgtgggatcaggccagcgccatgaccggcggcctggacgccgcagacctggcccggctgggtcgtgaaggggtgctggcgctgtccaccgctgaggcgctggaactgttcgacaccgcaatgatcgtcgacgagccattcctggcgcccgcccgcattgacctcaccgcactgcgagcccatgcggtggcggtgccgcccatgttctccgacctagccagcgcgccgacccgccgtcaggtcgacgactccgtggccgccgcaaagtcgaaatcggcgctcgcgcatcgcctgcacgggctgcccgaagccgaacagcacgccgtcttgctaggcctggtgcgtttgcacatcgccaccgtgctgggcaacatcacgccagaagccatcgaccccgacaaggcgttccaggacctgggttttgactcgttgaccgcggtcgaaatgcgtaaccggctcaaatccgccaccggcctttcactttcacccacgctcatcttcgactacccgacacccaatcggctggcctcctatatccgcaccgaacttgccggcctcccacaggaaatcaagcacacacccgcggtacgcaccacgagcgaggatccgatcgcgatcgtgggcatggcgtgccgctatcccggcggggtgaattccccggacgacatgtgggacatgctgatccagggccgcgacgtgctctccgaattcccggcggaccgcgggtgggacctggccgggctatacaaccccgaccccgacgccgcgggtgcgtgctacacccgcaccggcggctttgtggacggggtcggcgacttcgaccccgccttcttcggggtggggccgagcgaggccctcgcgatggatccacagcatcggatgttgctggagttgtcctgggaggcgttggagcgggccggtatcgatccgaccggattgcgcggcagcgccaccggggtattcgccggggtaatgacgcaaggctacggcatgttcgccgccgagccggtagaaggcttccggctgaccggccaattgtccagcgtcgcctcgggtcgggtggcctatgtgctggggttggagggtccggcggtgtcggtggatacggcgtgttcgtcgtcgttggtggcgttgcatatggcggtgggatcgctgcggtcgggggagtgcgatctggcgctggctggcggcgtcaccgtcaacgccacacccgacatcttcgtggaattcagccgctggcgcggattatccccggacgggcgctgcaaggcattcgccgcggcggccgacggcaccggattctccgagggcggtgggatgttggtgctgcagcggctttcggatgcgcggcggttgggtcatccggtgttggcggtggtggtcgggtcggcggttaatcaggatggggcgtcgaatgggttgaccgcgcctaatggtccttcgcagcagcgggtggtgcgggcggcgttggccaatgccgggttgagcgcggccgaggtggatgtggtggaggggcatgggaccgggaccacgttgggggatccgattgaggctcaggcgttgttggccacttatgggcaagatcggggggagccgggagaacctttgtggttggggtcggtgaagtcgaatatgggtcatacgcaggccgcggcgggggtggccggggtgatcaagatggtgttggcgatgcgccatgagctgttgccggcgacgttgcacgtggatgtgcctagcccgcatgtggattggtcggcgggggcggtggagttgttgaccgcgccgcgggtgtggcctgctggtgctcggacgcgtcgtgcgggggtgtcgtcgtttgggattagtggcactaatgcgcatgtgattatcgaggcggtgccggtggtgccgcggcgggaggctggttgggcggggccggtggtgccgtgggtggtgtcggcgaagtcggagtcggcgttgcgggggcaggcggctcggttggccgcgtacgtgcgtggcgatgatggcctcgatgttgccgatgtggggtggtcgttggcgggtcgttcggtttttgagcatcgggcggtggtggttggcggggaccgtgatcggttgttggccgggctcgatgagctggcgggtgaccagttgggcggctcggttgttcggggcacggcgactgcggcgggtaagacggtgttcgtcttccccggccaaggctcccaatggctgggcatgggaatgggattgcacgccggatacccggtgttcgccgaggcgttcaacaccgtagtgggcgaacttgaccggcatctgctgcgcccactgcgcgaagtgatgtggggtcacgacgaaaacctactgaacagcacggaattcgcgcagcccgcgctgttcgcggtggaagttgccctgttccggttgctgggatcctggggtgtacgaccggattttgtcatgggccactcgatcggtgagttgtctgcggcacatgtcgccggtgtcctgtcgttggagaacgctgcggtgttggtggctgcccgcggccggctcatgcaggcgttgccggccggtggggcgatggtcgccgtgcaagccgccgaggaagaggtgcggccgctgctgagcgctgaggttgacatcgctgcggtcaacggtccagcgtcactggtgatttcgggtgcacaaaacgccgtggccgcggtggccgaccagctgcgcgccgacggacgacgagtccaccagctggcggtttcccacgcgttccactcgccgttgatggatccgatgatcgacgaattcgcagccgtcgctgccggaatcgccatcggccggcccaccatcggagtcatctccaacgtgaccgggcagttggcgggcgacgatttcggatcagcggcctactggcgacgtcacatccggcaagccgtgcggttcgccgacagtgtgcgcttcgcgcaggcggccggaggcagccgattcctcgaagtcgggcccagcggtggccttgttgcgtcgatcgaagagtcgttgcccgacgttgcggtgacaacgatgtctgcgctgcgcaaggatcgccccgagccggcgacgttgaccaacgccgtcgcgcaagggtttgtcaccggtatggacctggattggcgcgctgtggtaggcgaggcgcagtttgtcgagttgccgacgtatgccttccaacggcggcggttttggctgtccggtgatggtgtcgcggcggacgcggccggcttggggttggcggccagtgagcacgcgctcttgggcgcggtgatcgatctgccggcctcgggcggggtggtgttgacgggtcggctgtcgcccagcgtgcagggctggttggccgaccactccgttgccggcgtgacgatcttcccgggagcgggatttgtggagttggcgatccgcgccggcgacgaagtgggttgtggcgttgtcgacgaatcaacgctggccgcgccgttggtgttgcccgcatccggttcggtggcggttcaggtggtcgtcaatggtcccgacgagtccggcgtgcgcggggtgtcggtgtattcgcgtggtgacgtcggtaccggctgggtgttgcacgccgagggcgcgctgcgcgccgggtcggcggaaccgaccgcggatctagcgatgtggccgccggcgggcgccgtcccggttgaggtggcggacggctatcagcagctggccgagcgcggatacggctacgggccggcgtttcggggactgaccgcgatgtggcgccggggtgatgaggtgttcgcggaggtggcgttgcccgccgatgccggggtctcggtcaccggcttcggggtgcatccggtgctgctggatgcggccttgcacgcggtggtgttgagcgcggaaagcgccgagcgtggccaaggttcggtgttggtcccgttctcctggcagggggtctcgttgcatgcagcgggggcgtcggcggtgcgggcccgcatcgcgccagtgggtccgtcggcggtgtcgatcgagctggccgatgggttgggattgccggtgttgtcagtcgcttccatgctggcccgaccggtgaccgatcagcaattgcgggcggcggtgtcgagctcgggtccggaccggctattcgaggtcacctggtcgccgcagccatcggccgcggtggagccgctaccggtgtgcgcctgggggacaacggaggactcggcggcggtggtgtttgagtcggtgcctctggccggtgacgtagtggcgggcgtgtatgccgccacgagttcggtgcttgatgtgttgcagtcgtggctaacccgtgatggggcaggggttttggtggtgatgacccgcggtgcggtggcattgccgggcgaagatgtcaccgatttggcgggtgccgccgtatggggattggtgcggtcggcgcagaccgagcatccgggccggatcgtgctggtcgattccgatgcgccgctcgacgattcggccctggcggcggtagtgacgacaggcgagccgcaggtgttgtggcggcgcggggaggtttatacggcgcgggtgcacggtagccgcgcggtgggcgggctgttggttcctccgagtgaccggccgtggcggttggcgatgagcaccgccggcaccttcgagaatctgcggctggagctgattcccgatgccgacgcgccgctgggccccgggcaggttcgagttgcggtgtccgcgattgccgccaacttccgcgacgtcatgatcgcgctgggtctgtatcccgatccggacgcggtcatgggcgttgaggcctgcggcgtcgttatcgaaaccagcttgaacaagggatctttcgcggtcggagaccgggtaatgggcctgttccccgagggcaccggaaccgtcgccagcaccgaccagcggctgctggtcaaggtgccggcggggtggtcgcacacggccgccgccaccacctcggtggtgttcgccaccgcccactacgcgctggtggatttggccgctgctaggtcgggccagcgcgtgttgatccatgccggcaccggcggggtgggcatggcggcggtgcagctggctcggcatctggggttggaggtgttcgcgaccgcgagcaagggtaagtgggacaccttgcgcgccatgggctttgacgacgaccacatatccgattcacgtagcctagagttcgaggacaagttccgcgcggccactggcggtcgagggttcgacgtggtgttggactcgctggccggtgaattcgtggatgcgtcgctgcgtctggtggcaccgggtggggtgttcttggagatgggcaagaccgacatccgcgaccccggcgtgatcgcccagcagtacccgggcgtgcgctaccgcgccttcgacctattcgaaccgggaccggaccgcattgcgcagatccttgccgagctcgccacgctgttcggcgatggggtgctgcggccgttgccggtcaccacttttgacgtgcggtgcgcgcctgcggcgttgcgttatctgagccaggcgcgccacaccggcaaggtcgtcatgctgatgcccggctcgtgggcggcgggcacggtgttgatcaccggtggcaccgggatggcgggttcggcggtggcccgtcacgtggtggctcgtcatggggtgcgcaatctggtgttggtgagccggcgcggcccggatgctcccggggctgcggagctggtggccgagttggccgccgccggtgcgcaggtgcaggtggtggcctgtgacgcggcggatcgagcggcgttggccaaggtgatcgccgatattccggttcagcatccattgtcgggcgtgatccacaccgccggcgcactcgacgacgcggtggtgatgtcactgacaccggatcgggtggatgtggtgttgcggtccaaggtggacgcggcgtggcacctgcacgagttgactcgcgacctggatgtgtcggcgtttgtcatgttttcgtcgatggccgggctggtcggatcgtcgggccaggccaactatgcggccgccaattcgtttttggatgcgctggccgcccaccggcgggcccatgggctgccggccatctccctgggctggggtctgtgggatcaggccagcgccatgaccggcggcctggcgacggtggacttcaaacgcttcgcccgcgacggcatcgtggcgatgtcgtctgctgacgccctgcaattgttcgacaccgcaatgatcgtcgacgagccattcatgctgcccgcccacatcgactttgcggcgttgaaggtcaagttcgatggcggcacgttgccgccgatgttcgtcgatctgatcaacgcgccgaccaggcgccaggtcgatgactcgttggccgcggcgaaatcgaaatcggctctgctgcaacgcctggaaggactgcccgaagacgagcaacacgccgtcctgctggacctggtgcgctcgcacatcgccaccgtgctgggtagcgccagccccgaagccatcgacccggatagggcattccaggagttgggtttcgactcgctcaccgcggtcgaaatgcgcaaccggctcaaatccgccaccggcctggcgctttcacccacgctcatcttcgactaccccaactccgcggcgctggccggctatatgcgtcgagaactgctcggctcatcaccgcaagacacttcagccgtggcggccggggaagccgaactacaacgcattgtggcgtccattccggtcaagcgcttacggcaggcgggagtgctggatctgttgctcgcgctggcaaatgaaaccgaaaccagcggccaggacccggcgttggcgccgaccgcagaacaagagatcgcggacatggacctcgacgacctggtcaacgcggcgtttcggaacgacgacgagtag

SEQ ID NO: 288 - DNA, 336 bp, Mycobacterium Tuberculosis
atggctgatcgtgtcctgaggggcagtcgcctcggagccgtgagctatgagaccgaccgcaaccacgacctggcgccgcgccagatcgcgcggtaccgcaccgacaacggcgaggagttcgaagtcccgttcgccgatgacgccgagatccccggcacctggttgtgccgcaacggcatggaaggcaccctgatcgagggcgacctgcccgagccgaagaaggttaagccgccccggacgcactgggacatgctgctggagcgccgttccatcgaagaactcgaagagttacttaaggagcgcctcgagctcattcggtcacgtcggcgcggctga

SEQ ID NO: 289 - DNA, 165 bp, Mycobacterium Tuberculosis
atggcgcgcaccgacatccggccgattgtgaagctgcgttccacggcgggcaccggctacacctacaccacccgcaagaaccgccgtaatgaccccgaccgtctcatcttgcgcaaatacgacccgatcctgcggcgtcacgtggactttcgcgaggaacgctga

SEQ ID NO: 290 - DNA, 414 bp, Mycobacterium Tuberculosis
gtggcgatggtcaacaccactacgcggcttagtgacgacgcgctggcgtttctttccgaacgccatctggccatgctgaccacgctgcgggcggacaactcgccgcacgtggtggcggtaggtttcaccttcgaccccaagactcacatcgcgcgggtcatcaccaccggcggctcccaaaaggccgtcaatgccgaccgcagtgggcttgccgtgctcagccaggtcgacggcgcgcgctggctctcactggagggtagggcggcggtgaacagcgacatcgacgccgtgcgcgacgccgagctgcgctacgcgcagcgctatcgcaccccgcgtcccaatccacgccgagtggtcatcgaggtccagattgagcgcgtgctgggatccgcggatctgctcgaccgggcctga

SEQ ID NO: 291 - DNA, 441 bp, Mycobacterium Tuberculosis
atgtttgcgaacgccgggttgtcgccgtttgtcgcgatttggaccgcccgcgctgccagtttgtacacctcgcataacttttggtgcgcggcggcggtttctgctgcggtgtatgtcggctcggcggtcgttccagcggcggtggctggaccgctgttcgtcgggcgcgtcagtgccacgattaaagctgcggcacccagcacaaccgcggcaatcgcgacgctggccaccgccgccaacggccaattgcgtgaacgcggcggcgctggggggtgggttggtgtccattgtcctgtggtgggtggggggggtgttggtcacccgcgtaaggctattgcagctgccgtgtctgtgcactccacctgcatgccagcagcgtttggtggccaccttggcctgggcgaccgcagtaggtcggtttcgttgtcggggacgccgtag

SEQ ID NO: 292 - DNA, 2721 bp, Mycobacterium Tuberculosis
gtgactgagctggccgagctggaccggttcaccgcggaactaccgttctcgctcgacgactttcagcagcgggcttgcagcgcgctggaacgcggccacggtgtgctggtgtgcgcgccgaccggcgctggcaagacggtggtcggcgagttcgccgtgcacctggcgctggcggccggcagtaaatgtttctacaccacgccgctgaaagccctgagcaaccaaaagcacaccgatctcacagcacgctacggccgtgaccagatcgggctgctgaccggtgacctgtcggtcaacggcaacgcgccggtggtggtgatgaccaccgaagtgctgcgcaacatgctctacgcggattcgcctgcgctgcaggggctttcctatgtggtgatggatgaggtgcatttcctcgccgaccggatgcggggtccggtgtgggaggaggtgatcctgcaactgcccgacgacgtgcgggtggtcagcctgtcggcgacggtgagcaacgccgaggagttcggcggttggatccagacggtgcggggcgacaccacggtggtggtcgacgagcatcggccggtgccgttgtggcaacacgtcttggtgggcaagcgcatgttcgacctgttcgattaccggatcggcgaagccgaagggcagccccaagtcaaccgcgagttgctgcgccacatcgcgcatcgccgtgaggccgaccggatggccgattggcagcctcggcgccgaggctcgggccggcccggcttctaccggccacccggccgacccgaggtgatcgccaaactcgacgctgaagggctgttgccggcgatcaccttcgtgttctcccgggccggttgtgacgccgcggtcacccaatgcctgcggtcaccgctgcggttgaccagcgaagaggagcgcgcacggatcgccgaggtgatcgaccaccgctgcggtgacctggccgactccgacctggcggtactcggctactacgaatggcgggaagggttactgcgcggtctggccgcccaccacgcgggcatgttgccggccttccggcacacggtggaggagctgttcaccgccggtttggtcaaggctgtattcgccaccgagactctggcgctcggtatcaacatgccggcccgcacggtggtgctggagcggctggtgaagttcaacggtgagcagcacatgccgctgacgccgggggagtacacccaactgaccggtcgcgccggccggcgcggtatcgacgtcgagggtcacgcggtggtgatctggcacccggaaattgaaccgtccgaggtggcgggcctggcctccacccgcacctttccgctgcgcagctcgtttgccccgtcgtacaacatgacgatcaacctggtgcaccggatgggtccgcaacaggcgcaccgactgctcgagcagtcgttcgcccaatatcaggccgaccgatccgtggtcggactggtccgcggaattgagcggggcaacaggatactcggcgagatcgcagccgaactgggcggatctgatgcgcccatcctcgaatacgctcgattgcgcgcgcgggtgtccgagctggaacgtgcgcaggcccgcgcgtcgcggttacagcgacggcaggcggccaccgatgcgctggccgcgctgcgccgcggtgacatcatcaccatcacccacggccgccgcggtggtctggccgtcgtcctggaatcagcccgcgaccgcgacgacccgcgtccgctggtgctaaccgaacaccgatgggcgggacggatctcctcggccgactactcgggcacgacgccggtggggtcgatgacgctgcccaagcgggtggagcaccgccagccgcgggtccggcgtgacctggcctcggcgctgcgatcggcagccgcgggtctggttattccagccgcccggcgcgtcagcgaggccggcgggtttcacgatccggagctggagtcgtcgcgcgaacaattgcgccgtcatccggtgcatacctcgcccgggctcgaggaccagatccgccaggccgagcgttacttacgcatcgaacgcgacaacgcgcaattagagaggaaggtcgccgccgccaccaactcgttggcccgcacgttcgaccgattcgtcgggctgctcaccgaacgggagttcatcgatggcccggccactgatcccgtggtcaccgacgacggccggctgctggcgcggatttacagcgagagcgacctgttggtggccgagtgcctacgtacaggtgcgtgggagggtttaaagccggccgaattggcgggggtggtgtcggcggtggtctacgagacgcgcggtggtgacggccagggcgccccgttcggagccgatgtgcccacaccgcggttacggcaggctctgactcagacatcaaggctgtccacgacattgcgcgccgacgagcaggcacaccgcatcaccccgagtcgcgaacccgacgatggctttgtcagagtcatctaccgctggtcgcgaaccggtgatctagcggcggcattggccgctgccgacgtgaacggcagcggatcaccgttattggcaggggatttcgtgcgttggtgccgtcaggtgctcgatctgctggaccaagttcgtaacgctgcgcccaaccccgaactgcgggctaccgcaaagcgcgctatcggtgacattcggcgcggcgtcgtcgcggttgacgccgggtag

SEQ ID NO: 293 - DNA, 927 bp, Mycobacterium Tuberculosis
gtgcgcgccgccggtcttctcaaacggctcaacccacgtaacaggcgcagccgcgtcaatcctgacgcgacgatgtcgctggtcgaccacctgaccgagttacgcaccaggttgctgatctccctggccgcgatcttggtcaccacaatcttcgggttcgtctggtattcgcattcgattttcgggttggacagcctcggagagtggctgcggcatccctactgtgccctgccgcagtcggcccgggcggatatcagcgccgacggagagtgccgtttgttggccaccgcgccgttcgaccagttcatgttgcggctcaaggtcgggatggccgccggcattgtgctggcttgcccggtgtggttctaccagctgtgggcgttcatcacgcctggtctctaccagagggagcgccgcttcgcggtggccttcgtgatcccagcagcggtgctgttcgtcgccggtgccgtactggcctacctggtgttgtccaaggcgttgggctttttgttgaccgtcggcagcgacgtgcaggtgaccgcgctgtctggcgaccgctactttggctttctgctcaacctgctggtggtgttcggggtcagcttcgaattccccctgctgatcgtgatgctgaacctggcgggcctgctgacctatgagcggctcaagtcttggcggcgcgggttgatctttgcgatgttcgtcttcgcggcgatcttcacgcccggatccgatccgttctcgatgaccgcgctcggtgcggcgttgaccgtgctgctagagctcgccattcagatcgcccgcgtgcatgacaagcgaaaagccaagcgcgaagccgcgattcccgacgacgaagcttcggtcatcgacccgccctcgccggtgccggcgccatcggtcatcggatctcatgacgacgtcacgtag

SEQ ID NO: 294 - DNA, 252 bp, Mycobacterium Tuberculosis
gtgggcagtctgagtccgtggcattgggcgatcctcgctgtcgtggtgatcgtgttgttcggtgccaagaagctccccgatgcggcgcgctcgttgggcaagtcattgcgaatctttaagtccgaggtccgtgaactgcagaacgagaacaaagcggaagcgtctatcgagacccccacgccggtgcaatcgcagcgtgtcgacccctcagcggcgtctggtcaagacagcaccgaggctcggccggcttag

SEQ ID NO: 295 - DNA, 297 bp, Mycobacterium Tuberculosis
atgtcctttgtgaatgtagacccatttgggatgttggcggcagctgcgacactggagtcccttggttcccacatggcggtaagcaatgccgcggtggcctcggtgaccaccaaggttcctcccccggccgccgactacgtatcaaaaaagttatcgctgttctttagtagccacgggcagcagtaccaggtgcaagccgctcggggcacggcctttcatcgaaaattggtccggaccctggcgaatggcgcgcttgcgtatgaggaagtcgagatcgccaacaacgaaggtttctaa

SEQ ID NO: 296 - DNA, 732 bp, Mycobacterium Tuberculosis
atgcccaatttctgggcgttgccgcccgagatcaactccacccggatatatctcggcccgggttctggcccgatactggccgccgcccagggatggaacgctctggccagtgagctggaaaagacgaaggtggggttgcagtcagcgctcgacacgttgctggagtcgtataggggtcagtcgtcgcaggctttgatacagcagaccttgccgtatgtgcagtggctgaccacgaccgccgagcacgcccataagaccgcgatccagctcacggcagcggcgaacgcctacgagcaggctagagcggcgatggtgccgccggcgatggtgcgcgcgaaccgcgtgcagaccacagtgttgaaggcaatcaactggttcgggcaattctccaccaggatcgccgacaaggaggccgactacgaacagatgtggttccaagacgcgctagtgatggagaactattgggaagccgtgcaagaggcgatacagtcgacgtcgcattttgaggatccaccggagatggccgacgactacgacgaggcctggatgctcaacaccgtgttcgactatcacaacgagaacgcaaaagaggaggtcatccatctcgtgcccgacgtgaacaaggagagggggcccatcgaactcgtaaccaaggtagacaaagaggggaccatcagactcgtctacgatggggagcccacgttttcatacaaggaacatcctaagttttga

SEQ ID NO: 297 - DNA, 747 bp, Mycobacterium Tuberculosis
gtgagttttccgtatttcatctcgcctgagcaggcgatgcgcgagcgcagcgagttggcgcgtaagggcattgcgcgggccaaaagcgtggtggcgctggcctatgccggtggtgtgctgttcgtcgcggagaatccgtcgcggtcgctgcagaagatcagtgagctctacgatcgggtgggttttgcggctgcgggcaagttcaacgagttcgacaatttgcgccgcggcgggatccagttcgccgacacccgcggttacgcctatgaccgtcgtgacgtcacgggtcggcagttggccaatgtctacgcgcagactctaggcaccatcttcaccgaacaggccaagccctacgaggttgagttgtgtgtggccgaggtggcgcattacggcgagacgaaacgccctgagttgtatcgtattacctacgacgggtcgatcgccgacgagccgcatttcgtggtgatgggcggcaccacggagccgatcgccaacgcgctcaaagagtcgtatgccgagaacgccagcctgaccgacgccctgcgtatcgcggtcgctgcattgcgggccggcagtgccgacacctcgggtggtgatcaacccacccttggcgtggccagcttagaggtggccgttctcgatgccaaccggccacggcgcgcgttccggcgcatcaccggctccgccctgcaagcgttgctggtagaccaggaaagcccgcagtctgacggcgaatcgtcgggctga

SEQ ID NO: 298 - DNA, 1830 bp, Mycobacterium Tuberculosis
atgggtgagtcagagcgttctgaggcattcggcatcccccgggatagcccgctgtccagtggtgatgccgccgaattagaacagctgcggcgcgaggctgcggtcctgcgcgagcaacttgagaacgccgtcggatcacatgccccgacgcgctctgcccgcgatatacatcaactcgaagcccgtatcgactcacttgctgcccgcaattccaaattaatggaaactcttaaagaagcccgtcaacaactgctggcgctgcgcgaggaagttgaccggctggggcagccgcccagtggctacggcgtcctgctggccacgcacgacgacgacacggtcgatgtgttcacatcgggtcgcaagatgcgcctgacgtgctcaccgaatattgacgctgcatcgctgaagaaggggcagacggtccggctcaacgaggccctgaccgtcgtggaggccggcacattcgaggcggtcggcgagatatccaccttgcgcgagatcctggccgacggtcatcgggctctggtcgtcggccacgccgacgaggaacgcgttgtttggctggctgatcccctgatcgccgaggacctgccagacggcctccctgaggccctcaacgatgacacccggccgcgcaagctgcgccccggcgactcgctgctggtcgacaccaaagccggctatgccttcgaacgcatccccaaagccgaggtagaagacctggtgctggaagaggtgccggacgtcagctacgccgacatcggcggtctgagccgccagatcgagcagatccgcgacgccgtggagctgccgttcctgcacaaggagttgtaccgggagtactcgctgcgcccgcccaagggtgtgttgctctatggcccacccggctgtggtaagacgttgatcgccaaggctgtggccaactcgttggccaagaaaatggccgaggtccgcggcgacgatgcccacgaggcgaagtcgtacttcctcaacatcaagggccccgagctgctgaacaaattcgtcggggaaacggaacgccacatccggctgatcttccaacgggcccgcgagaaggcgtcggaaggcactccggtgatcgtgtttttcgacgagatggactcgatctttcgcacccgtggcaccggcgtttcctcggacgtcgagaccacggtggtcccgcagctgctcagcgagatcgacggggtggagggactcgagaatgtcatcgtgatcggcgcctccaaccgagaggacatgatcgaccctgccatcctgcggcccgggcgcctcgacgtgaagatcaagatcgagcggcctgatgccgaagcggcgcaggacatctactcgaagtacctgaccgagttcttgccggtgcacgccgacgatctcgccgagttcgacggtgaccgttcggcctgcatcaaggcgatgatcgagaaggttgtcgaccggatgtatgccgagatcgacgacaaccggttcctggaggtcacctatgccaacggcgacaaggaagtcatgtacttcaaggacttcaactccggggcgatgatccagaacgtcgtcgaccgagccaagaagaacgccatcaaatcggtgctggagaccggccaaccgggactgcgtatacagcatctgctcgattcgatcgtcgacgagttcgccgagaacgaggatttgcccaacaccaccaaccccgatgactgggcgcggatctcgggcaagaagggggagcggatcgtctacatccgcaccctggtcaccggaaagagttcgtcggccagcagggctattgataccgagtccaacctcggccagtacctgtag

SEQ ID NO: 299 - DNA, 570 bp, Mycobacterium Tuberculosis
atgcgccgaaacatccgtgtaaccctgggcgccgccaccatcgtggcggcgttagggctctccgggtgttcacaccctgagttcaagcgttcgtcgccgcctgccccgtcactgccgcccgtcacgtcgagcccgctcgaggccgcgccgatcacgcccctgcccgcacccgaagccctgatcgatgtgctgtcccggctcgccgacccggccgtgccgggcaccaacaaggtgcagctcatcgagggcgcgacccccgaaaacgccgctgccctggacaggttcaccaccgcactgcgtgacgggagctacttgcccatgaccttcgcggccaacgacatcgcatggtcggacaacaagccgtccgacgtgatggccaccgtcgtcgtcaccactgcccatccggacaaccgcgagttcacgtttcccatggaattcgtgtccttcaagggcggctggcaattgtctaggcagaccgcggaaatgctgctggccatgggtaactcaccggattcgactccgtcggctaccagcccggcgccggccccatcaccgactccccctggctga

SEQ ID NO: 300 - DNA, 282 bp, Mycobacterium Tuberculosis
gtgcaacaatcgctggccgtgaagaccttcgaggatctgttcgccgaactcggcgatcgtgcccgcacccggccggccgacagcaccacggtggcggcattggacggcggggttcatgctctgggtaagaagcttctcgaggaggccggcgaggtgtggctggctgccgagcacgaatccaacgacgcactggcggaggagatcagccagttgctgtactggacgcaggtgctgatgatctcccgtggactgtccctcgacgacgtctatcgaaagctgtga

SEQ ID NO: 301 - DNA, 1470 bp, Mycobacterium Tuberculosis
ttgagcgcggcctcacagcgtgtcggcgccttcggcgaagaggccggctatcacaaaggcctcaagccccgacaactgcagatgatcgggatcggcggcgcgattgggaccggcctgttcctcggcgccggcggccggcttgccaaggccggacctgggttgttcttggtgtacggcgtgtgcggggtttttgtcttcctgatcctgcgggcgctgggtgagctggtgctgcaccgtccgtcgtcaggctcgtttgtgtcgtatgcacgtgaatttttcggcgagaaggccgcttacgcggtgggctggatgtacttcctgcactgggcgatgacgtcgatcgtggacaccaccgcgatcgccacctacttgcagcgttggacgatcttcacggtggtcccgcaatggattcttgccctgatcgccttgacggtggtgttgtcgatgaacctgatttcggtcgaatggttcggcgagctggagttttgggccgcgctgatcaaggttctcgcgctgatggcgttcctagtggtgggaaccgtttttttggccgggcgataccccgtcgacggccacagcaccggattgagcttgtggaacaaccatggcgggctgttcccgacaagctggctgccgctgctgatcgttacctcgggagtggtgttcgcgtactcagcagtcgaattggtagggacggcggccggggagaccgccgagccggagaagatcatgccgcgggcgatcaattcggtggtcgctcgcatcgcgatcttttatgtcgggtcggtggccctgctagcgctgttgctgccgtataccgcctacaaggccggcgagagcccgttcgtcacgttcttttccaaaatcggtttccacggtgccggtgacttgatgaacatcgttgtgcttaccgccgcgctgtcgagcctgaacgcggggctgtattcgaccggccgcgtcatgcattcgatcgcgatgagcggcagcgccccaaggttcaccgcgcgaatgtcgaaaagcggtgtgccctacggcgggatcgtgttgaccgcggtcatcaccctgttcggtgtcgcgctgaacgccttcaagcccggtgaagccttcgagattgtgctcaacatgtccgcgctgggcatcatcgcgggttgggccaccatcgtgctgtgtcagcttcgacttcacaagctggccaacgccgggatcatgcagcggccgcggttccgcatgcccttctccccctacagcggctacctcaccttgctcttcttgcttgtcgtgctggttacgatggcgtccgacaaaccgatcggcacctggacggtggcgacactgattattgtcattccggccctgaccgcaggctggtacctggtacgcaagcgtgtcatggccgtcgcccgcgaaaggctgggtcataccgggccatttccggcggtcgccaacccgcccgtgaggtcaagagactga

SEQ ID NO: 302 - DNA, 882 bp, Mycobacterium Tuberculosis
atgacatcgctgcaaggcaaggtcgtcttcattaccggtgctgcccggggaatcggggctgaggtcgcccgtcggctgcacaacaagggcgccaaactggtgctgaccgacctgagcaaatcagagctggcggtgatgggcgccgaactcggcggcgacgaccgcctactcaccgtggtagccgacgtgcgcgacctgcccgccatgcaggccgcagccgagacggccgtcgaacgattcggcggcatcgacgtcgtcgtggccaacgccggcatcgccagctacggctccgtgctgaaggtcgacccgcaggcgttccggcgggtgttggacgtcaatttgctgggtaacttccacacggtgcgggcgacgttgcccgcgctgatcgaccgccgcggttacgtattgatcgtctcgtcgcttgccgcgttcgcggcgccgcccgggatggcgccctacaacatgtcgaaggcgggtaacgagcacttcgccaacgcgttgcgactcgaggtcgcacacctgggcgtcagcgtcggctcggcgcacatgtcgtggatcgacaccgcgttggttcgcgataccaaggccgacctgcctgcgttcgccgaattgctggcgcgcctcccttggccgttgaacaagaccacgtcggtcaacaagtgtgcggccgcattcgtcaacggcattgagggccgaaaagatcgcgtgtactgcccgggctgggtggccctgttccgttggctcaagccgttgttgtccacccgggtaggccaacgtcccatccgcaacaccgttgccaagctgatgccccagatggatgccgaggtcgccgcgctcggccgctttgccagcgcctacaccgaatcactcgagaattcctag

SEQ ID NO: 303 - DNA, 1077 bp, Mycobacterium Tuberculosis
ttgctaacagggaataaaccagcagttcaacgccgcttcatcggcctgttgatgttgtcagtcctggtcgcaggctgttcttcgaacccgctggctaacttcgcacccgggtatccgcccaccatcgaacccgcccaaccggcggtgtcaccgcctacttcgcaagacccggccggtgcagtgcgaccactgagcggccacccccgggcggcactattcgacaacggcacccgccaattggtggctctgcgcccgggcgccgattcggcggcacccgccagcatcatggtcttcgatgacgtgcacgttgcaccgcgcgtcatttttctgccgggcccggcagccgcgttgaccagcgacgaccacggcacggccttccttgccgcccgcggcggctacttcgtggccgacctgtcctccggtcacaccgcacgagtgaatgtcgctgacgcagcgcacaccgatttcaccgcgatcgcccgccgctccgacggcaagctggtgctgggcagcgcagatggcgccgtctacacgcttgccaagaaccccgcagttgacccggcgtccggcgccgccaccgtagccagccggaccaagatcttcgcgcgcgtggatgcccttgtaacacaagggaatacaaccgttgttctggatcgtggccagacctcggtgaccacgatcggcgccgacggtcatgcccagcaggcactgcgcgccggccaaggtgcgacgaccatggccgccgatccgctgggccgggtgctgatcgccgacacccgtggtggccaactactggtgtacggcgtcgacccgctgatcttgcgccaggcctacccggtgcggcaggctccgtacgggctggccggatcccgcgaattggcgtgggtgtcccaaaccgcgtccaacaccgtcattggttacgatctgaccaccggaatacccgtagagaaggtgcgttacccaaccgtgcaacaacccaactcgttggccttcgacgaaacgtcggacaccttgtacgtggtgtcgggatccggtgccggggtccaggtcatcgaacacgcggcgggcacccgatga

SEQ ID NO: 304 - DNA, 1074 bp, Mycobacterium Tuberculosis
atgtatcccctggtgcgtcggctgttgttcctgatcccacccgagcacgcgcacaagttggttttcgccgtgctgcgcggcgtggccgccgtggcgccagtgcgccggctcttgcgccgactgctgggcccgacggatccggtgctggccagcacggtgttcggggtgcgcttcccggcaccgctcgggctggccgcggggttcgacaaggacggcaccgcactatccagttggggtgcgatggggttcggctacgccgagatcggcaccgtcaccgctcatccgcagcccggcaacccggccccccgcctgttccggctggccgacgaccgcgccctgctgaaccggatggggttcaacaatcacggtgcccgggcactggcgatccgactcgcgcggcaccgacccgagatcccgatcggggtgaatatcggcaagaccaagaaaacgccggccggcgacgcggtcaacgactaccgggccagcgcccggatggtcggcccgctggcgtcgtatctggtggtcaacgtcagctctccgaacacaccggggttacgcgatctgcaggcggtcgaatcgctgcggcccatcctgtctgccgtccgcgccgagacttcgacgccggtgctggtgaagatcgcgccggacttgtccgattccgacctcgacgacatcgcggacctggccgtcgagctagacctggccggcatcgtggcaaccaacaccacggtgtcacgcgacggcctgaccacaccgggggtcgaccggttgggtcccggcggcatctcggggccaccgctggctcagcgcgcggtccaggtgctgcgtcggctctatgaccgggtcggtgatcgattggcgctgatcagcgtgggcgggatcgagacggccgacgacgcgtgggagcgcatcacagcgggcgcatcgctgctacagggctataccggcttcatctacggcggggaacggtgggccaaggacatccatgaaggcattgcccgcaggctgcatgacggcgggttcggctcgctgcacgaagcggtcggctcggcaagacgtcggcaacccagctaa

SEQ ID NO: 305 - DNA, 531 bp, Mycobacterium Tuberculosis
atgacaacttcacccgacccgtatgccgcgctgcccaagctgccgtccttcagcctgacgtcaacctcgatcaccgatgggcagccgctggctacaccccaggtcagcgggatcatgggtgcgggcggggcggatgccagtccgcagctgaggtggtcgggatttcccagcgagacccgcagcttcgcggtaaccgtctacgaccctgatgcccccaccctgtccgggttctggcactgggcggtggccaacctgcctgccaacgtcaccgagttgcccgagggtgtcggcgatggccgcgaactgccgggcggggcactgacattggtcaacgacgccggtatgcgccggtatgtgggtgcggcgccgcctcccggtcatggggtgcatcgctactacgtcgcggtacacgcggtgaaggtcgaaaagctcgacctccccgaggacgcgagtcctgcatatctgggattcaacctgttccagcacgcgattgcacgagcggtcatcttcggcacctacgagcagcgttag

SEQ ID NO: 306 - DNA, 357 bp, Mycobacterium Tuberculosis
atgctgatcattgcgctggtcttggccctgattgggctcctggccttggtgttcgcggtggtcaccagcaaccagctagtggcctgggtatgcatcggggccagcgtgctgggtgtggcgttgctgatcgtcgatgcgttgcgagaacgccagcaaggtggcgcggacgaagctgatggggctggggaaacgggtgtcgcggaggaagccgacgtcgactacccggaggaagcccccgaggagagccaagccgtcgacgccggtgtcatcggcagtgaggagccatcggaggaggccagcgaagcgaccgaggagtcggcggtatcggcggaccgaagcgacgacagcgccaagtag

SEQ ID NO: 307 - DNA, 726 bp, Mycobacterium Tuberculosis
gtgaatagtcactgtagtcacaccttcatcacagacaacagatctcccagggctagaaggggtcacgcaatgagcacactgcacaaggtcaaggcctacttcggtatggctcccatggaggattacgacgacgagtactacgacgaccgcgctccctcgcgcgggtatgcgcggccccgattcgacgacgactacggccgctacgatgggcgcgactacgacgacgcgcgcagcgattcacgcggtgacctgcgcggtgagccggccgactatccaccaccgggatatcgcggcgggtacgcggacgaaccacgtttccggccccgggagttcgaccgcgcggagatgacacggccgcgcttcggatcgtggctgcgcaactccacccgcggcgcgctagcgatggacccccgccggatggcgatgatgttcgaggatggccatccgctctcgaagatcaccacgctgcggcccaaggactacagcgaggctcgcaccatcggtgagcggttccgcgacggcagcccggtcatcatggatctggtgtcgatggacaacgccgatgccaagcggctggtcgatttcgcggccggcctggccttcgcgctgcgcggctcgttcgacaaggtcgcgaccaaggtgttcctgctctcgcctgcagacgtcgatgtgtcccccgaggagcgccgcaggatcgccgaaaccgggttctacgcctaccaatag

SEQ ID NO: 308 - DNA, 945 bp, Mycobacterium Tuberculosis
atgacggaacacaacgaggacccacagatcgagcgcgtggccgacgacgccgccgacgaggaggcggttacggagccgttggccaccgaatcgaaggacgaaccggccgagcacccagaattcgaagggccgcgtcggcgcgcccgccgcgaacgtgccgaacgtcgcgccgcgcaggctcgagctaccgcgatcgagcaggctcgccgcgcggccaaacggcgagcccgcgggcagatcgtcagtgagcagaaccccgccaaaccggccgcccgaggtgttgttcgagggctgaaggcgctgctcgcgacggtcgtgctggccgtcgtcgggatcgggcttgggctcgcgctgtacttcacgccggcgatgtcggcccgcgagatcgtgatcatcgggatcggggcggtgagccgcgaggaggttctcgacgccgccagagtgcggccggcaacgccgttgctgcagatcgacacccaacaggttgctgaccgagtggccacgatccggcgggtggccagtgcgcgggtgcagcggcagtacccgtcggccttgcggatcaccatcgtcgagcgggtcccggtggtggtcaaggatttttcggacggcccgcacctttttgaccgcgacggcgtcgacttcgcgaccgatccgccaccgccggcgttgccttatttcgatgtggacaatcccggtcctagcgatccgacgaccaaggcggcgctgcaggtgttgaccgcgctgcatcctgaagttgcaagccaggtggggcggatcgcggccccgtcggtggcctcgatcaccctgacgttggccgatggccgcgtggtgatctggggaaccaccgaccgctgcgaagagaaggccgaaaagctggcggcgctgttgacccagccaggcagaacgtacgacgtgtccagccccgacctgccgaccgtgaaatag

SEQ ID NO: 309 - DNA, 1233 bp, Mycobacterium Tuberculosis
gtgaaggacacggtcagccagccggccggcgggcgcggggcaacggcgccccggcccgccgatgccgcctcgccgtcttgtggttcctcgccgtctgctgattccgtgtcggtcgttctcgccggcggcgggaccgccgggcacgtcgagcccgccatggccgtcgccgacgccttggtcgcgttggatccgcgcgtccggattaccgcgttgggcaccctccgtggactagagaccaggctggtgccccagcgcggctaccacctggagctgatcacggcggtgccgatgccgcgcaagcccggcggcgacctggcccggctgccgtcgcgggtgtggcgcgccgtccgggaggcccgggacgtgctcgacgatgtcgacgccgacgtcgtcgtcggtttcggtgggtacgtcgcgctaccggcttacctagccgctcgcggcctgcctttgccgccccggcgccggcgccggatcccggtggtgatccacgaagccaacgccagggcgggactggccaaccgggtcggcgcccataccgcggaccgggtgctctccgcggtgccggattccgggctgcggcgcgccgaggtggttggggtcccggtccgtgcgtcgatcgccgcgctggaccgcgcggtgctgcgagccgaggcgcgggcacacttcggcttccccgacgacgcgcgggtgctgctggtgttcgggggttcgcagggcgcggtctcgctcaaccgggcggtgtccggcgccgccgccgacctggccgccgccggtgtttgcgtgctgcatgcccatggaccccagaacgtgctggagttgcgccgtcgggctcaaggtgacccaccgtacgtggcggtgccctatttggaccggatggagctggcctacgccgccgccgatctggtgatctgccgggccggggcgatgacggtcgccgaagtatccgccgtcggtctgccggccatctacgtgccgctgccgatcggcaacggtgaacagcggctgaatgcgttgccggtagtcaatgccggcggcggcatggtggtcgccgacgccgccctgacccccgagttggtggcccgccaggttgccgggctgctcaccgaccccgcgcggctggccgcgatgaccgcggccgcagccagggtgggacatcgcgatgccgcgggccaggtggcccgggccgcgctggccgtcgccaccggggccggtgccaggacaacgacgtga

SEQ ID NO: 310 - DNA, 621 bp, Mycobacterium Tuberculosis
ttggcgatattcctcatcgatctgccgcccagcgatatggagcgccgcctcggtgatgccctgacggtgtatgtcgacgcgatgcgctaccccaggggcaccgagactttgcgcgccccaatgtggctggagcacatccggcggcgcggctggcaggcggtcgcggccgtcgaggtaacggcagccgaacaggccgaggccgccgacaccacggcgctgccgtcggccgccgaactgagcaacgcgccaatgctcggagtggcgtacggctatcccggggcgcccggccagtggtggcaacagcaggtggtactgggcttgcaacgcagcggctttccgcgcctagcgatcgcccgactgatgaccagctacttcgagttgactgaattgcacatccttccccgcgctcaaggccgtggcctcggggaggcgttggcccgccgactgctagccggtcgcgacgaggacaacgtcctgctctccacaccggagaccaacggtgaggacaatcgggcgtggcggttgtaccgccggttgggcttcaccgacatcatccgcggctaccacttcgccggtgacccccgagcattcgccatcctgggtcgcacgctaccgctctaa

SEQ ID NO: 311 - DNA, 1551 bp, Mycobacterium Tuberculosis
atgactactccgagccatgctccagcggttgatttggctacagcgaaagatgctgttgtccaacacctttcgcgacttttcgagttcactaccggtccgcagggcggaccggcgcggctgggcttcgccggcgcggtgctgatcaccgcaggcgggctgggagccggcagcgtccgccaacatgacccgctgctggagtcgattcacatgtcctggctgcgcttcggccacggactcgtgctgtcgtcgattctgttgtggacaggtgtgggtgtgatgctgcttgcgtggctgggtctaggccgacgggtcctcgccggcgaagccaccgagttcaccatgcgggcaaccaccgttatctggctggcgccgctactgctgtcggtgcccgtcttcagccgggacacttactcgtatctggcccaaggggcgcttctgcgcgacggtctggatccttacgctgttggcccggtcggtaatcccaatgcgctgctggacgacgtaagcccgatctggacgatcaccaccgcgccctacggtcctgcgttcattctggttgcgaagttcgtcacggtaatcgtcggcaacaatgtcgtcgccggaaccatgctgttgcgtttgtgcatgctgcccgggctggcgttgctggtctgggccactccacgcttggccagccatctcggcacccacggcccgaccgcgctgtggatctgcgtgctgaacccactggtcctcatccatctgatgggcggggtgcacaacgagatgctgatggtgggtctgatgaccgccggtatcgcgttgaccgtccagggccgtaatgtcgcggggatcatcctgatcaccgttgcgatcgcggtgaaggccaccgccggaatcgcgttgcccttcttggtctgggtttggctgcgtcatctgcgtgagcgacgggggtaccggccggtccaggcgttcctggcagccgccgcgatatcgctgctgatcttcgtcgcggtgttcgcggtgctgtctgcggtagccggcgttggcctagggtggctgaccgcgctggccggctcggtgaaaatcatcaactggctgacggtgcccaccggggcggccaacgtgatccacgcgctgggcagagggctcttcacggtcgacttctacaccttgctgcggatcacccggctgatcggaatcgtgatcatcgcggtgtcgctgccgctgttgtggtggcggttccggcgcgacgaccgggccgcgctgaccggggtcgcatggtcgatgctgatcgtggtgctgttcgtacccgccgccctgccgtggtactactcctggccgctggcggtcgctgccccgttggcccaggcacgacgggcgatcgcggccatcgccgggctctcgacttgggtgatggtgatcttcaaacccgacggatcgcacgggatgtattcgtggctgcacttctggatcgccaccgcctgcgcactgactgcgtggtatgtcctgtatcggtcaccggaccggcgcggagtgcaggctgcaaccccggtggtcaatacgccatag

SEQ ID NO: 312 - DNA, 1284 bp, Mycobacterium Tuberculosis
atgagtgcatggcgggcgcccgaggtgggcagtcgactcgggcggagggtgttgtggtgcctgctgtggctgctggccggcgtggcgttgggctacgtggcctggcggttgttcggccacacgccgtatcgcatcgatatcgacatctatcagatgggcgctcgagcttggctggacgggcgtccgctgtatggcggtggtgtgttgttccacacacccatcgggctgaacctcccgttcacctatcctccactggcggccgtcctgttcagcccattcgcctggttgcagatgccggctgccagcgtcgcgatcacggtgctaaccctggtgctgctgatcgcgtcgacggcgatcgtgctgaccggcctcgacgcatggccaacctcccgactggtacccgcgccggctcggttacgccggttgtggttggccgtgctcatcgtggctccggcaacgatttggctggagccgatcagctcgaacttcgctttcggtcagatcaatgtggtgctgatgaccctggtgatcgtcgactgcttcccacgccgaacgccatggccacgcgggctgatgttggggctggggatagccctcaaactcacccccgcggtgtttctcctctacttcctgctacgtcgggacggtcgggccgcgctgacggcgctggcgtcgttcgcggtcgccacgctgctcggtttcgtcctggcgtggcgcgactcctgggagtactggacgcatacccttcaccacacggaccggatcggcgctgccgccttgaacacagaccagaacatcgcgggcgcactcgcgcggttgacgattggcgatgacgaacgcttcgcactgtgggtggccggatccctgctcgtgttggcagcgaccatatgggcgatgcggcgagtgttgcgggccggcgagccgaccctggctgtgatctgcgtcgccctgttcgggttggtagtttcgccggtctcgtggtcacaccattgggtgtggatgctgccggccgtgctggtgattgggctactgggttggcgtcgccgcaacgtcgcgttggccatgctcagcctggccggggtggtgctgatgaggtggacaccgatcgacctgcttccccaacaccgggagacgactgcggtctggtggcgtcaactcgcggggatgtcctacgtgtggtgggcgctggcggtcatcgtcgttgccggactcaccgttaccgccaggatgacgccgcagcgctcgcttacgcgcggactgaccccggcgccgacggccagctga

SEQ ID NO: 313 - DNA, 435 bp, Mycobacterium Tuberculosis
gtggcggacaagacgacacagacgatttacatcgacgcggatccaggcgaggtgatgaaggcgatcgccgacatcgaagcctacccgcaatggatttcggagtataaggaagtcgagatcctagaggccgacgacgagggctacccgaaacgagcgcgaatgttgatggacgcagccatcttcaaagacaccttgatcatgtcctacgagtggccggaagaccgccaatcgcttagctggactctcgaatccagctcgctgctaaagtccctcgaaggcacgtatcgcttggcgcccaagggttctggcactgaggtcacctacgagcttgccgtcgaccttgctgtccccatgatcgggatgctcaagcgtaaggcggaacgcaggttgatagacggcgcgttgaaggatctgaagaaacgagtcgagggctga

SEQ ID NO: 314 - DNA, 645 bp, Mycobacterium Tuberculosis
atggtgagcagatattccgcataccggcgtgggccggatgtaatctcgccggacgtcatcgatcgcatcctggttggggcatgtgccgcggtgtggctggtgttcaccggcgtgtcggtggccgccgctgtcgccctgatggacctgggtaggggcttccacgagatggccggaaacccgcacaccacgtgggtgctgtacgccgtaattgtggtctccgcactggtcatcgtgggcgcgataccggtgctgttgcgagctcgccgcatggctgaggccgagcccgcgacgaggccgacgggtgcatccgtgcggggcgggcgatcgatcggatccgggcatccggcgaaacgcgctgtggccgagtcggcacccgtacagcacgcggatgcattcgaggtggccgccgagtggtccagtgaggcggtggaccggatctggttgcgcgggacagtcgtgttgaccagtgcgattggcattgcgttgattgccgtggcggcggcgacctacctcatggcggtcggtcacgacgggccatcttggatcagctacgggttggccggggtggtcaccgcgggcatgccggtgatcgagtggctatacgctcggcagctgcgccgggtggtggcgccccagtccagttag

SEQ ID NO: 315 - DNA, 711 bp, Mycobacterium Tuberculosis
gtgaagctgctgggccaccggaagagccatggacaccaaagggccgacgcatcacccgatgccgggtcgaaagatggttgccggcctgattccggacgcacgtccgggtcggacacatcgcgcgggtcgcaaaccaccggccccaagggccggcccacgcccaagcgcaaccaatcccgtcgccacaccaagaagggcccggtcgcaccggcaccaatgactgcggcccaggcacgggcccggcgcaagtcgcttgccggccccaaacttagccgcgaggaacggagagccgaaaaggccgcaaaccgggcccggatgacggaacgccgggaacgcatgatggccggcgaagaggcctacctgctcccgcgcgaccggggcccggtacgccgctacgtgcgcgatgtggtggactcccggcgcaacctgctcgggctgttcatgccctcggcgttgaccctgctgttcgtcatgtttgccgtgccgcaggtgcagttttacttgtctccggcgatgttgatactgctggccttgatgacgatcgacgcgatcatcttgggtcgcaaagttggccggctggttgacacgaagttcccgtctaacaccgaaagccggtggaggctgggtctttacgccgccggccgagcttcccagatacgccggttgcgggcgccccgaccccaagtcgagcgcggcggcgatgttggctaa

SEQ ID NO: 316 - DNA, 693 bp, Mycobacterium Tuberculosis
gtgacgggttctatccggtcgaagctgtccgcgatcgacgtccgccagctggggaccgtcgactaccggaccgcgtggcagctacagcgagagctagccgacgcccgggtcgccggcggcgccgacacgctgctgctgttggaacaccccgcggtctacaccgccggacggcgtaccgagacacacgagcgacccattgacggcactccggtcgtcgacaccgaccgcggcggcaagatcacctggcacggtccggggcaattggtcggctacccgatcatcgggctggccgaacccctcgacgtggtcaattacgttcggcgccttgaagaatcgctgatccaagtctgcgccgatctgggcctgcacgccggccgcgtcgacggccggtccggggtctggctgcccggcaggccggcgcgcaaggtcgcggccatcggtgtccgggtgtcgcgggcgacgacactgcacgggtttgcgctcaactgcgattgtgatttggctgccttcaccgccatcgtgccatgcggaatcagtgacgccgcagtgacatcgctgtccgccgaactcggccgtacggtcaccgtcgacgaggtccgcgcgacggtcgccgccgctgtctgcgccgctctggacggcgtcctaccggtcggtgaccgcgtgccctcacacgccgtaccatcgccgttatga

SEQ ID NO: 317 - DNA, 936 bp, Mycobacterium Tuberculosis
atgagtgtcgctgccgagggccggcgcctgttacgcctggaggtgcgcaacgcgcagaccccaatcgagcgcaaaccgccgtggatcaagacacgagcccgcatcgggccggagtacaccgagctgaagaacctggtccgccgcgaggggctgcacacggtctgcgaggaggccggctgccccaacatcttcgaatgctgggaggaccgagaagccaccttcctgatcggcggtgaccagtgcacccgccgatgcgatttctgccagatcgacaccggaaagcccgccgagctggaccgcgacgagccacgccgagtcgccgacagcgtgcgcacgatgggcctgcgctatgccaccgtcaccggcgtggctcgcgacgacctgcctgacggcggggcctggctgtacgccgcgaccgtgcgcgccatcaaggaactcaatccgtcgaccggcgtcgaactgctgattcccgacttcaacggcgaaccaacccggctggccgaggtcttcgagtccggcccggaagtcctggcacacaatgtcgaaaccgtgccccgtatcttcaagcggatccggccggcgttcacgtaccggcgcagcctgggtgtgcttaccgctgcgcgcgacgccggcctggtcaccaagagcaacctcatcctcggcctgggcgaaacctccgacgaggtgcgcaccgccctgggcgatctgcgcgacgccggctgcgacatcgttaccatcacccaatacctgcggccgtcggcgcgccaccatccggtcgagcgctgggtgaagcccgaggagttcgtccagttcgcgcgattcgccgaagggctgggcttcgccggggtattggcgggacccctggttaggtcgtcatatcgggcgggccggctctacgaacaggcacgtaactcacgggccttggcatcccgctag

SEQ ID NO: 318 - DNA, 2985 bp, Mycobacterium Tuberculosis
gtggtcgtgaccaaactcgccacgcagcggccgaagttgcccagcgttggccggctcggattagttgacccccctgctggtgagcgtctggctcagctggggtgggatcggcacgaggatcaggcgcacgtcgacctgctgtggtcgctgtcacgcgctccggacgccgatgccgcgctgcgcgccttgatccggctgtcggagaatccagacaccggatgggacgagctcaacgcggctctgctgcgcgaacgcagtctgcgcgggcggctgttctcggtgctgggctcgtcgctggcgttgggcgatcacctggtcgcccatccgcagtcctggaaattgctgcggggcaaggtcacactgccgtcccatgaccagctgcagcggtcgttcgtcgagtgcgtcgaggaatcggagggtatgccgggctcgctcgtgcaccgattgcgaacccagtaccgcgactacgtgctaatgctggccgctctcgacctggccgcgacggtcgaggacgaaccggtgctgccattcaccgtggtggccgcacgcctggcggacgccgcggacgccgctctggcggcggcgctgcgcgtggccgaggcgagcgtgtgcggcgagcacccgccaccgcgcctggcggtcatcgcgatgggcaagtgcggtgcgcgcgaactgaactacgtcagcgacgtcgatgtcatattcgttgccgagcgctccgacccgcgcaacgcgcgcgtggccagcgagatgatgcgggtggcctcggcggcctttttcgaggtggacgccgccctgcgtccggaggggcgcaacggggagctggtccgtacgctcgagtcgcacatcgcctactaccagcgctgggccaagacctgggagtttcaggcgttgctgaaagcacggccagtcgttggcgacgcggaacttggcgagcgttacctgaccgccttgatgccgatggtgtggcgagcctgcgagcgcgaagactttgtggtcgaggtgcaggccatgcggcggcgggtggagcagctggtgcccgccgatgtccgcggccgcgagctcaaactcggcagcggcggattgcgcgacgtggagttcgccgtacagctactgcagctggttcatgcccgtagcgacgagtcgttacgggtggcgtccacggtggacgcattggcggcgttgggcgaaggcggctacatcgggcgtgaggacgcggcgaacatgaccgcgtcgtatgagttcctcaggctgctcgagcaccgactgcagttgcagcggctcaagcgcacccacctgcttcccgatcccgaagacgaggaggcagtgcgctggctggcgcgcgcggcccacatccggcccgatggccgaaacgatgcggccggggtgctgcgggaggaactcaagaagcagaacgtgcgggtgtcgaagttacacaccaaactcttctatcaaccgctgctggaatcgatcggcccgaccgggttggagatcgcccacggcatgacgttggaggccgcggggcgccggctggccgcgctgggctacgagggaccgcagaccgcgttgaaacacatgtcggcgttggtcaatcaaagcggccggcgcggacgggtgcagtcggtgctgctgcccaggctgctggactggatgtcgtatgcccccgatcccgacggcggactgctggcctaccggcggctcagtgaggcgctggccaccgaaagctggtacctggccacgctgcgggacaagcccgcggtggccaagcggctcatgcatgtcttgggtacctcggcgtatgtgccggatctgttgatgcgcgcgccgcgggtcatccagcagtacgaggacgggcctgcgggcccgaagctgctcgagaccgagcccgccgccgtggctcgggcgctgatcgcctcggcgagccgctaccccgacccggagcgggccatcgccggcgcgcgcacgctgcgtcgtcgagagctggcccgcatcggttcggcggacctgctcggcctgctcgaggtcaccgaggtgtgccgggcgttgacgtcggtgtgggtggcggtgctgcaggccgcgctggacgtcatgatccgggccagccttcccgacgacgatcgcgccccggcggccatcgcggtcatcggcatgggtcggctgggtggtgccgagttgggctacgggtcggatgccgacgtgatgttcgtctgtgagccggccaccggcgtcgacgatgcacgggcggtgaaatggtcgacatcgatcgccgagcgggttcgggcgctgctggggacacccagcgtcgatccgccgctggagctcgacgccaatttgcgacccgagggccgcaacggtccgctggtccgcaccctggggtcctacgccgcatactacgagcagtgggcacagccatgggagatccaggccctgctacgcgcacacgcggttgccggcgatgccgagttgggtcagcgattcctacggatggtcgacaaaacgcggtatccgcccgacggtgtgtccgctgactcggtgcgcgagattcgccgcatcaaggcccgtatcgagtccgagcggttgccgcgcggtgccgaccccaacacacacaccaaactgggccgcggcggactggccgacatcgaatggaccgtgcagttgctgcagctacagcatgcgcaccaggttcccgccctgcacaacacctcgacgctgcaatccctggatgtcatcgcggccgccgatctggttcccgcagccgacgtggagctgctccgtcaggcctggctgaccgccacccgggcccgcaacgcgctggtgttggtgcgcggcaagcccaccgaccagctgccgggacccgggcgccagctcaatgcggtcgcggtcgcggccggctggcgaaacgacgacggtggggaattcctggacaactacctacgggtgacgcggcgggcaaaggcggtagtgcgcaaagtgttcgggagttga

SEQ ID NO: 319 - DNA, 1341 bp, Mycobacterium Tuberculosis
atggaccgacagaaggaattcgttcttcgtaccctggaagaacgcgacatccgcttcgtccggctgtggttcacagacgtgctcggtttcctcaagtcggtcgccatcgccccagccgaactcgagggcgccttcgaggaaggcatcggcttcgacggatcctcgatcgagggctttgcgcgggtctcggaatccgatacggtggcgcacccggacccgtcgaccttccaggtgctgccctgggccaccagttccggccaccaccactcagcgcggatgttttgcgacatcaccatgccggacggctcgccgtcgtgggcggacccgcggcacgtgttgcggcggcagctgacgaaggccggcgaactcggcttctcctgctacgtgcatcccgaaatcgagttcttcctgctcaagcccggacccgaggacgggtcggtgcccgtcccggtcgacaacgccggctatttcgaccaagcggtgcacgactccgccttgaactttcgccgccacgcgatcgatgccctggaattcatgggcatctcggtggagttcagccatcacgaaggcgcacccggccagcaggagatcgacctgcggtttgccgacgctctgtcgatggctgacaacgtgatgaccttccgctacgtcatcaaagaagtcgcgctggaagagggcgcccgggcgtcgttcatgcccaagccattcggccagcacccgggctcggcgatgcacacccacatgagcctgttcgagggtgatgtcaacgcgttccacagcgctgatgatccgctgcagctgtcggaagtgggtaaatcgttcatcgccgggatcctggagcacgcttgcgagatcagcgcggtcacaaatcagtgggtcaactcttacaagcggctggtgcagggcggcgaagcgcccacggccgcgtcgtggggggccgccaaccgatccgccctagtgcgggtgccgatgtacacgccgcacaagacctcgtcgcggcgggtcgaagtacgcagccctgattcggcgtgcaatccctatctgacattcgccgtgctgctggccgcgggattgcggggtgtagagaagggttacgtgctgggcccgcaggccgaggacaacgtatgggacctcacacccgaggaacgccgagcgatggggtaccgagaattgccgtccagtttggatagtgcgctgcgcgccatggaggcctccgaactcgtcgcggaggccttgggggagcacgtttttgactttttcttgcgcaacaagcgcacggagtgggcgaactaccgcagccacgtcacgccatacgagctgcgcacctacctgtcgctgtag

SEQ ID NO: 320 - DNA, 1563 bp, Mycobacterium Tuberculosis
gtgggcatgaggctgtctcgccgcgacaagatcgcgcgcatgctgttgatctgggccgcgctcgccgccgtggcgttggttcttgtgggctgcatccgcgtggtcgggggacgcgctcgtatggcggagccgaagctgggccagccggtggagtggacaccgtgccggtcgtcaaacccgcaagtaaagatccccggcggcgcgttatgcggcaagctcgctgtaccggtcgactacgaccgccccgatggtgacgtggcggcgctggcgctgattcgctttccggcgacgggagacaagatcggttcgctggtcataaatcccggtggacccggcgaatccggtatcgaggccgccttgggcgtcttccagacattgccgaagcgggtgcacgaaaggttcgacctggttgggttcgacccccgcggggtggcgtcgtcccggccggcgatctggtgcaactccgatgccgacaacgaccggctgcgggccgagccgcaggttgactacagccgggagggtgtggcgcacatcgagaacgagaccaagcaattcgtcggtcgctgtgtggacaagatgggcaagaactttctggcccatgtcgggacggtcaacgtcgccaaggacctggatgccattcgcgcggcgttgggcgacgacaagctgacctacctgggctactcgtacggcacccggatcggctccgcgtatgccgaggaatttccgcagcgggtgcgggcaatgattctcgacggtgccgtcgaccccaatgccgatcccatcgaggcggagctgcgccaggccaagggcttccaggacgcgttcaacaactatgccgccgactgcgccaagaacgcgggctgcccgctgggcgccgacccggccaaagccgtcgaggtctaccacagcctggtcgatccgttggtcgacccggacaacccgaggatcagcaggccggcgcgcacgaaggatccgcgcgggctgagttatagcgacgccatcgtgggcaccattatggcgctgtactcaccgaatctgtggcaacacttgaccgacgggctgtcggagctggtcgacaatcgcggagacaccctgctggctctggccgacatgtacatgcgtcgggactcgcacggccgctacaacaattccggtgacgcgcgggtggcgatcaattgcgtcgatcagcccccggttaccgatcgcgacaaggtcatcgacgaagaccgccgcgcccgggagatcgcaccgttcatgagctacgggaagttcaccggtgatgcgccgctgggcacctgcgcgttctggccggtgccacccacaagtcagccccatgccgtctcggcgcccggcctagtgccgacggtggtggtatccaccacccatgacccggcgacgccgtacaaggccggggtcgacctggcgaaccagcttcgcggttcgttgctgaccttcgacggaacccagcacacggtggtattccagggcgacagctgcattgacgagtacgtgacggcgtatttaatcggcggcaccacgccgcccagcggcgccaagtgctag

SEQ ID NO: 321 - DNA, 909 bp, Mycobacterium Tuberculosis
gtgattgcgttgctcgcacccggacagggttcgcaaaccgagggaatgttgtcgccgtggcttcagctgcccggcgcagcggaccagatcgcggcgtggtcgaaagccgctgatctagatcttgcccggctgggcaccaccgcctcgaccgaggagatcaccgacaccgcggtcgcccagccattgatcgtcgccgcgactctgctggcccaccaggaactggcgcgccgatgcgtgctcgccggcaaggacgtcatcgtggccggccactccgtcggcgaaatcgcggcctacgcaatcgccggtgtgatagccgccgacgacgccgtcgcgctggccgccacccgcggcgccgagatggccaaggcctgcgccaccgagccgaccggcatgtctgcggtgctcggcggcgacgagaccgaggtgctgagtcgcctcgagcagctcgacttggtcccggcaaaccgcaacgccgccggccagatcgtcgctgccggccggctgaccgcgttggagaagctcgccgaagacccgccggccaaggcgcgggtgcgtgcactgggtgtcgccggagcgttccacaccgagttcatggcgcccgcacttgacggctttgcggcggccgcggccaacatcgcaaccgccgaccccaccgccacgctgctgtccaaccgcgacgggaagccggtgacatccgcggccgcggcgatggacaccctggtctcccagctcacccaaccggtgcgatgggacctgtgcaccgcgacgctgcgcgaacacacagtcacggcgatcgtggagttcccccccgcgggcacgcttagcggtatcgccaaacgcgaacttcggggggttccggcacgcgccgtcaagtcacccgcagacctggacgagctggcaaacctataa

SEQ ID NO: 322 - DNA, 348 bp, Mycobacterium Tuberculosis
gtgcctgtcactcaggaagaaatcattgccggtatcgccgagatcatcgaagaggtaaccggtatcgagccgtccgagatcaccccggagaagtcgttcgtcgacgacctggacatcgactcgctgtcgatggtcgagatcgccgtgcagaccgaggacaagtacggcgtcaagatccccgacgaggacctcgccggtctgcgtaccgtcggtgacgttgtcgcctacatccagaagctcgaggaagaaaacccggaggcggctcaggcgttgcgcgcgaagattgagtcggagaaccccgatgccgttgccaacgttcaggcgaggcttgaggccgagtccaagtga

SEQ ID NO: 323 - DNA, 930 bp, Mycobacterium Tuberculosis
atgagcgccgggcagctgcgccggcatgagatcggcaaggtcaccgcgctgaccaatcccctgtcaggccatggcgccgccgtaaaggctgcacacggcgcgatcgcccggctgaagcatcggggggtggacgtcgtcgagatcgtcggcggggacgcccacgacgcacgccatctgctcgccgcggcagtcgcaaaaggcactgacgcggtgatggtgaccggcggtgacggagtcgtctccaacgcgctacaggtcttggcgggcaccgacattccgttaggaatcattccggccggcactggtaacgaccacgcacgcgaattcgggcttcccacaaagaatcccaaggcagccgcagatatcgttgttgacggctggacggaaaccattgacctgggccggattcaagacgacaacggtatcgaaaagtggttcggtaccgtggcggctaccggattcgactccctggtcaacgatcgcgccaaccgaatgcgctggccacacgggcggatgcgctattacatcgcgatgctcgccgaactgtcgcggctgcggccgttgccgttccggctggtgctcgacggcaccgaagagatcgtcgccgacctcacacttgccgacttcggcaatacccgcagctacggcggcggattattgatctgccccaacgccgaccactcggacggcctgctcgacatcaccatggcccagtcggattcccgtaccaagttgctccgcctgttccccaccattttcaaaggcgcccatgtcgagcttgacgaggtgagcaccacacgagccaagacagtccacgtcgagtgccccggtatcaacgtctatgccgacggcgacttcgcctgcccgttaccagccgagatctccgcggtgccggccgcccttcaggttcttcgcccccgccacggataa

SEQ ID NO: 324 - DNA, 504 bp, Mycobacterium Tuberculosis
atgtccggacaccgcaagaaggcaatgctcgccttggcggctgcgtcgctggcagcgacgctggccccgaacgcagtcgcggccgcagaaccgtcgtggaacgggcagtacctcgtgacgttgtctgccaacgcgaaaaccggcaccagcatggcggccaaccggccagagtatccacacaaagcgaactacacgttcagctcgcgctgcgcgtccgatgtctgcattgccaccgtggtcgacgctccgccaccaaaaaacgagttcatcccgcggccaatcgaatacacctggaatgggactcaatgggtacgggagatcagctggcaatgggactgcctgctacccgacggcacaatcgaatatgccccagccaaatcgatcacggcctacacgcccggtcagtacggaatcctcaccggcgtctttcataccgatatcgccagcggcacgtgtaaaggcaatgtcgacatgccagtgtcggccaaaccgatcgttggctga

SEQ ID NO: 325 - DNA, 1062 bp, Mycobacterium Tuberculosis
atgagcggagcactcgagaccaccgaagaattcggcaaccgttttgttgcggccatcgacagcgccggtttggcgatcctggtgagcgttggacaccagaccgggctgctggacaccatggccggacttccgccagccaccagcatggagatcgctgaggctgcggggttggaagagcgctacgttcgggagtggctaggcggcatgaccaccgggcagatcgtcgaatacgacgcggggagctcgacctactcgctgcctgcccaccgcgccggcatgctgacccgtgcggccgggccggacaacctcgccgtgatagcacagttcgtttcgctgctcggcgaggtcgaacaaaaggtcattcgctgcttccgggaaggcggcggtgtgccctacagcgaatacccgcgcttccacaagctgatggccgagatgagcggcatggtgttcgatgccgccttgatcgacgtggtgctcccgctggtcgacggccttccggaccgcttgcggtccggagccgacgtggccgatttcggttgcggcagtggtcgcgcggtcaagctgatggcgcaggcgttcggcgcgagccgattcaccggcatcgacttttccgacgaggccgttgcggcggggaccgaggaggcggctcggttgggcctggcaaacgcgaccttcgagcgccatgacctggcagagctggacaaggtgggggcctacgacgtgatcaccgtgttcgacgcgattcacgaccaggcgcagccggcgcgcgtcctgcagaacatctatcgtgcgctgcgacccggtggtgtgctgctgatggtcgacatcaaggcatcgagtcaactggaagacaatgtcggcgttccgctgagcacctacctgtacacgacctcgctaatgcactgcatgacggtgtcgctggcgcttgacggggccgggttggggacggtgtggggcaggcagttggccacctcgatgctcgccgacgccggttttaccgacgtgacggtggccgagatcgagtcggacgtgttgaacaactactacatcgcccggaagtga

SEQ ID NO: 326 - DNA, 327 bp, Mycobacterium Tuberculosis
atgtcaggtggttcatcgaggaggtacccgccggagctgcgtgagcgggcggtgcggatggtcgcagagatccgcggtcagcacgattcggagtgggcagcgatcagtgaggtcgcccgtctacttggtgttggctgcgcggagacggtgcgtaagtgggtgcgccaggcgcaggtcgatgccggcgcacggcccgggaccacgaccgaagaatccgctgagctgaagcgcttgcggcgggacaacgccgaattgcgaagggcgaacgcgattttaaagaccgcgtcggctttcttcgcggccgagctcgaccggccagcacgctaa

SEQ ID NO: 327 - DNA, 195 bp, Mycobacterium Tuberculosis
atgctcgaaaaatgcccccacgcgagcgtcgactgcggtgcctcgaaaatcggcatcaccgacaacgaccccgcgaccgccaccaaccgcaggctggcgagcacaattcgcaagccgccgatcgagcacgcggccgggcccttagggtccacatcacgcgctggccaccgttcgtacggcggggtggcctcgtaa

SEQ ID NO: 328 - DNA, 378 bp, Mycobacterium Tuberculosis
gtgagccggcgccgcccgctgatcgaaccagcaacggttcaggttttggccattgctttcacagactcattcagcgtttcattgcactggccgcagcgcgagcagggctgccgcacagcgatcttggcgcctatgcgaaggtggtgcgatggtgatgtggacgggcgaaagttactgccaccggcacgccgcactggcacccaacagaggaggatcaggcccgccgcacccagggtctacacgaccggcgacatcctgcgtgatcggaagggcatagcgccatggcaggaacaacgcgaaccgggctgggcgccgttcggttggctgcacgagccctcgggcgcaaggtgcccaaaagccgacgggcagtcagtctaa

SEQ ID NO: 329 - DNA, 1224 bp, Mycobacterium Tuberculosis
gtgatacctaacccactcgaggagctaacgctcgagcaactgcgaagccaacgcacgagcatgaagtggcgtgcgcacccagccgacgtcttgccgttgtgggtcgcggagatggacgtgaagcttccgccgacggtggccgatgccctccgtagagctatcgacgacggcgacaccggatatccctatggaacggagtatgccgaagccgtccgcgaattcgcttgccaacgttggcaatggcacgacctggaagtgagccgcacggccatcgttcccgacgtcatgctcggcatcgtcgaagtgctgcgtctgatcaccgaccgcggtgaccctgtgatcgtcaactccccggtatatgcgccgttctacgctttcgtgtcgcatgacggccgccgagtgatcccagcgccgctgcggggagacggccggatcgatttggacgcgctgcaggaagcgttctcgagcgcgcgtgcttcaagcggctcgagcggcaacgtcgcctacctcctgtgcaatccgcacaacccgacggggtcggtgcacaccgccgacgaactgcgcggcatcgcggaacgcgcccaacggttcggtgtccgggtggtgtccgacgagattcatgcccctcttatcccgtccggggcacggtttacgccctatctgagcgtccccggtgcggaaaacgcattcgcactaatgtcggcttccaaggcgtggaatctcggcggactcaaggcagccctggccattgccggtcgcgaggcggcggccgacctcgctcggatgcccgaggaggtcggtcacggccccagccacctgggtgtcatcgcgcacaccgcggcgttcaggactggtggcaactggctcgacgcgctgctgcgcggtctggaccacaatcgaacgttgctaggcgctctggtcgacgagcatcttcccggggtgcaataccgatggccgcagggtacttacctggcgtggctggattgccgagaactcggcttcgatgacgcggctagcgacgagatgaccgaaggcctggcggtggtgtcagatctgtccgggccagcccgctggttcctcgaccacgcgcgggttgcgctcagttctggtcacgtcttcgggattggcggtgccgggcatgtgcgcatcaacttcgcgacctcccgagccattctcatcgaggcggtatcgcggatgagccggtcactactcgagcgccggtag

SEQ ID NO: 330 - DNA, 639 bp, Mycobacterium Tuberculosis
atggaccagtcggccaaccatgcgtgtctgcccaccccgctggcgagcacaacagggcgcgggcaagatcatgagatgcctgtcgaagagacctccaccccccagaagctgccccaatttcgttatcaccccgatcccgtcggcaccggctcgatagtcgccgacgaggtgagctgcgtgagctgcgagcaacgtcggccctacacctacaccggcccggtgtatgcggaggaggagcttaacgaggccatctgtccttggtgtatcgcagatggcagtgcggcgagtcgcttcgatgccacgttcaccgacgccatgtgggcggtgcccgacgacgttccagaggacgtgaccgaggaagtgctgtgccgaacacccgggttcacgggctggctgcaggaggaatggttgcatcactgcggggacgccgccgccttccttggcccggtgggcgccagcgaggtggccgacctccctgacgccctggatgcgctgcgcaatgagtaccgcggctacgactggcccgccgacaaaatcgaggaattcatcctgacgctcgatcgaaacgggctggcgaccgcctacctcttcaggtgcctgagctgcggcgtccacttggcctacgccgatttcgcttaa

SEQ ID NO: 331 - DNA, 933 bp, Mycobacterium Tuberculosis
atggtagcgacccgcggccgcccgtgcccgaccaatttttccaggccgcagcggccccgagtggccggcaatggcacaaagtcccagcggtgtcgcggtaggttgacgaccagtatgttaggtgtcgcccccgaagcgaagggaccgccggtgaaggtccaccacctcaactgcggcaccatgaatgcatttggcatcgctctgttatgccacgttctgctcgtcgagaccgacgatggattggtgctggtggacaccggcttcggtatccaggactgccttgaccccggccgggtaggtctattccgtcatgtcctgcggccggcattcttgcaggccgaaaccgcggcccgccagatcgaacagctcggctaccgcacgtccgacgttcgacacattgtgctcacccacttcgacttcgaccacatcggcgggatcgccgacttccccgaggctcacctccacgtcaccgccgccgaagcccgcggtgccatccacgccccttcgctccgcgagcgactgcgatatcgacgcggacagtgggcccacggcccgaagctggtggagcacggtcccgacggggaaccctggcgcggattcgcatcggccaaacccctcgattccatcggcaccggtgtcgttctggtgccgatgcccggtcacacccgcgggcacgccgcggtagctgtcgatgccggtcaccgctgggttttgcactgcggcgacgccttctatcatcgcggcaccctcgatggccggttccgggtgcccttcgtgatgcgggccgaggaaaagctgttgtcgtataaccgcaaccaactgcgcgacaaccaggcccgaatcgtcgaactccatcgacgccacgacccggatctactcatcgtctgcgcacacgatcccgacctctatcagcttgctcgcgatacggcctag

SEQ ID NO: 332 - DNA, 1149 bp, Mycobacterium Tuberculosis
atgcagttcctgagcgtgattccagagcaggtcgagtccgcggctcaagatttggcgggcattcgctcagcgctgagcgcgtcttacgcggccgcagcgggacccacaacagcggtggtttccgctgccgaggacgaggtgtcgaccgcgattgcgtcgatattcggcgcctacggtcgacagtgccaggttctcagcgcccaggcctccgcgtttcatgacgagttcgtcaacctgttgaaaactggcgcgactgcataccgcaacaccgaattcgccaacgcccaaagcaacgtgctgaatgcagtgaacgcaccggcccgatcgctgttggggcacccgagcgcggctgagagcgtgcagaactcggccccaacgctaggcggtggccacagcaccgtgaccgctgggcttgccgcacaggccggtcgtgccgtcgcgacggtcgaacaacaggctgcggctgcggttgccccgttgccaagcgccggcgccggactggctcaggttgtcaacggcgtcgtgaccgccggacagggttccgccgccaaacttgccaccgcgctgcagagcgccgcgccctggctggccaagagcggcggcgagttcatcgtggctgggcagagcgcgctgaccggtgttgctttgctgcaacctgccgtggtcggcgttgttcaggcgggcggtacgttcttgaccgccggaacgagcgctgctaccggactgggtctgctcacacttgctggtgttgagttcagtcaaggcgttggcaaccttgcgctggcttcagggaccgccgcgaccggacttggtctgctgggcagtgccggtgtgcaactgttcagtcctgcctttttactggctgtgcccaccgcgttgggtggagttggctcgctcgcgatcgcagtagttcagcttgtgcaaggcgtccaacacctgtcgttggttgtgccgaacgttgttgccgggatcgctgcactgcagaccgccggtgcccagtttgcccagggtgttaaccacacgatgctggccgctcagctcggtgcccctgggatagctgtcttacagaccgccggtggccattttgctcaaggcattggccacctgacgacggctggcaatgccgctgtcacggtgctgatctcctag

SEQ ID NO: 333 - DNA, 1548 bp, Mycobacterium Tuberculosis
atggaacagcacacgctgctgcaacgcgaggagtcgccgcgcagtcccgcggccccttcgctcaggcgcctgggtggctcacgtcacatcacgcattgggatcccgaggatctaggagcgtgggaggcaggcaacaagggcattgcccgacgcaatctgctttggtcggtcgtgacggttcacctgggttactcggtgtggacgctctggccggtgctggagttgctgatgccccaggacgtctacggcttttcaaccagtgacaagtttctgctcggcaccatcgcgacgctgtttggcgcgttcctgcggatgccctacgcgttggccagcgcgatctttggcggtcgcaactgggcgactttttcggcaatcgtgttgctaattccggccattggcacaacggtgttgttgacccatccggggctaccgctgtggccgtatctggtgtgtgcggccctgaccggcttaggcggcggcaacttcgcgtcgtcaatgagcaacgccaatgctttctatccacatcggctcaagggttcggcgctcggaattgccggtggggtaggcaatctcggggtgccggcgatccagctagttgggttgttggcaatcgccactgtcggtgagcggaagccttacctggtctgcgcactgtatgtggttctggtggcaatcgcggtaatcggagtgtcgctgttcatgaacaatgtcgaacagcaccgggtgcaggtgaaccggcttcggccgatcgtttccgcggttctgtcgacccgcgacacgtggttgctctcgctgctctacctcggcactttcggctcattcatcggcttctccttcgtgtttggccaggtgttgcagaccaacttcctggcgtgcggacaaagcccggcgcgcgcgacgctgcatgccgtcgagttggcgtttgtcgggccgttgctggcggcggtggcccggatttacggtggccggctggccgatcgagtcggtggaagccgcttgacccttatagtctttgtggcgatgacgctcgccgctgggctgctgatcagtgccagcaccctcgaaggccgacatgtcggccagcatcggggcgctaccatggtcggctacttcgtctgcttcgtcgcgttgttcgtcctatccgggttgggcaacgggtctgtgtacaagatgattccgacgatttttgaggcgtgcagccgctccctggatctcagtgaagccgaacgccgcgactggtcacgcatcatctcaggagtagtcatcgggtttgtggccgccttcggcgcgctcggcggggtcggaatcaatatggcgctgcgtgagtcctacctcagcaccggcagtgggaccgatgcgttctggatcttcatgatgtgctacgccgctgccgccgttctgacttggaaagtgtacgaccgccgaacggtcaccgacatggggatgttgcaggcggccttggtgcggcagccggcatcgacgccagccgaacttatcggtcccagaactcaatcggaccgattctccgggtgcagcatctcggcgtaa

SEQ ID NO: 334 - DNA, 1614 bp, Mycobacterium Tuberculosis
atgaaccgcacgcagctcctcacgctcatcgccactggcctgggcctgttcatgatctttctcgacgcactgatcgtgaacgtggcgctgcccgacatccagcgcagtttcgcggtgggggaggacggcctgcagtgggtggtggcgtcctacagcctcggaatggcggtcttcatcatgtcggcggcgacgcttgccgacctcgacggtcggcgccgctggtacttgataggtgtttcgttgttcacgctgggatctatcgcctgcgggttggcgccctcaatcgcggtgctcaccaccgcgcggggcgcgcagggcctaggtgcggcggccgtcagcgtaacctcgctcgccctggtcagcgcggcctttccggaggcgaaggagaaggcgcgcgccatcgggatctggaccgccatcgcgagcatcggtacgacgacgggcccgacactgggcggtctgctggtggaccagtgggggtggcgcagcatcttctatgtcaacctgcccatgggcgcactcgtcctcttcctgactttgtgctacgtcgaggagtcgtgtaacgagcgggcacgccgcttcgatctgtccgggcagctgctgttcatcgttgccgtgggtgccctggtgtatgcggtcatcgaaggcccccagatcggctggacgtctgtccagaccatcgtgatgctctggacagccgccgtcggctgcgccctgttcgtctggcttgagcgcagatcatcgaatccgatgatggatctgaccctgttccgcgacacctcatacgccctggccatcgcgaccatctgcacggtgttcttcgccgtctatgggatgctgctgctcaccacccagttcctgcagaacgtgcgcggctataccccgagcgtgaccggcctgatgatccttccgttcagtgcggccgtggccatcgtgtcgccacttgttgggcacctggttggccggatcggagcacgcgttcccatcctggcggggctgtgcatgttgatgctgggtctgctcatgctcatcttcagcgagcaccggagctcggccctggtcctggtcgggctgggcttgtgcgggagcggcgtcgcgttgtgcctgacgccgatcacgaccgtcgccatgaccgcggtccccgccgagcgtgcgggcatggcgtccggcatcatgagtgctcagcgggcgatcggctcgacgatcgggttcgcggttttgggctccgtccttgccgcctggctttcggccacactcgagccccatctggagcgcgcggtgcccgacccggtccagcgccacgtccttgccgagatcattatcgacagtgccaatccgcgagcgcatgtgggcggaatcgtcccccggcggcacattgagcatcgcgaccccgtcgcgattgcggaggaggatttcatcgaaggcattcgggtggcgttgctcgtcgccactgcaacactggctgtcgtgtttctcgccggctggcgatggtttccgcgtgacgtgcacaccgcgggcagcgacctaagcgagaggctgcctacagcgatgaccgtcgagtgcgcggttagtcatatgccgggagccacatggtgtcgactatggcctgcctga

SEQ ID NO: 335 - DNA, 1242 bp, Mycobacterium Tuberculosis
atgtcgcacgttaccgcggccccgaacgttctggcggcgtcggccggggagctagccgcgatcggctccactatgcgcgcggccaacgccgctgcggccgccccgacggcaggagtgctggctgccggcggcgatgacgtgtcggctggcatcgcggcgttgtttggcgcgcgggcgcaggcctatcaggccattagcgctcaagcggcgctgtttcacgaccggtttgtacagatcctgcaagagggcgcggcggcgtatgccatggctgaggccgccaacgccttgccgctgcagaaagcgcagggcgtggtcagcgaactcgcccaagatcgcactggggggacgggcaccgggcaatctcgcggtgccggcgggtttggcggtgtcggccaggctggcggaaagggctgggacggcggaccgatcggcaacggtcaggtcggcgagcagcatggggccggccagctcggcagcaccgacggtaaccccggagtggctggcgccgcgcacggcagcggcgtttctgcttcgcacggcagcggcgcaacaggtgccgccggtgtcgcggacccgggtggcagtggtgctggggtcggtagcgcagccggcaatgggactggggccggcagcgcagacgcagtcggtggtgccgggactggcagggacatcgtcgggtctgttcgcggggacggcggagtcggcatggccagcggtgacggcggtctgagcaccggcgctgcgggcgcttctgctgagggcgggttgatgcccggcttcggtggggctccgtgggttggcgggcactgggggctcggcggtgaaggccattccggtgctatcggcggagtgggtgaacaggtggcacctgcggtagccacggcacctgcggtgtcgccggctaccacgtctgcggtggcagccgaatccggctcgacgccggcgaccaaggcgcaggcgatgcacgcgacgaccaaccccggcaacgcggcacaccagggcaacccggccgacccgggcaactcggcgcgccgggctgatggcgggcgcgatgagcagctactgcttcttccgttgacgagtcttcgggggttgcgccacacgctaaagaagttgtccgggcttcgagctcgaaatgggctgctgacagcatccggcgacaatgctagtggcagcggccggccgtgggaccgcgaccaactgctgcgcgctcttggtcttcgaccgcccgggcacgaatga

SEQ ID NO: 336 - DNA, 420 bp, Mycobacterium Tuberculosis
atgccagtaggtggtcggcagcacgttttcgagaagctggccagcatcctgggcttggtcgccgcgccgctcatgctccttggattgagtgcctgcggccgcagcgccggcaagaccagcgaaccgacctgccccacggagccgatcgatgcggccgacagctcgacaacaccggacccctcgtgtgtggtgcgggccactgagatcaacggcaacgggtcgcgcatccagacctggaccggcagctatgatgcggccgcaacccagtccggtggtgtgtgtggtggcacctgcaacttccacgccacagtgcggttcacggtcgacgaaggccagatctcgggcagcgtcgatcaggtctatcaagcggcgatggttgctatcgcaacacgccccacttcgccatctctggcaccatga

SEQ ID NO: 337 - DNA, 258 bp, Mycobacterium Tuberculosis
ttgatcgggtatgtcgccgtgttgggactgggttacgtgctgggcgcaaaagccgggcgccgccgctacgagcagatcgcgagcacctatcgcgcactcaccggcagccccgtggccaggtcgatgatcgaaggcgggcgtcgcaagatcgccaatcggatctcacccgatgctgggtttgtgaccctggccgagatcgacaaccagaccgccgttgtccagcgcggggtcgagcggcagccgaaaaccgcgcgctga

SEQ ID NO: 338 - DNA, 4386 bp, Mycobacterium Tuberculosis
atgggaccagtggccgtgacgcgagccgacgcgcggggcgccatcgacgatgtgatggcgctcagcccattgcaacagggactgttttctagggcgacactggtcgccgcggagtccggctctgaggccgcagaggccgacccgtatgtgatcgcgatggcggccgacgcggccggcccgctcgacatcgccttgcttcgcgactgcgctgccgcgatgctgacccggcaccccaacctgcgggcgagcttcctacacgggaacctgagccggcccgtgcaggtaataccatccagtgccgaggtgctttggcgtcacgtgcgcgcccaccccagtgaggtcggggcgctggcagccgaagagcgccggcgccgcttcgacgtcggccgcggaccactcatccggttcctgctcatcgaactaccggacgaatgttggcatctggtcatcgtcgcgcaccacatcgtcatcgacggatggtcgttgccgctgttcgtctccgagctgctcgccttgtatcgggctggtggtcacgtcgccgcgttgccggcagcgccgcggccgtatcgcgactacatcggctggctggccggccgcgatcagacggctagccgcgcaatgtgggcggaccacctcaatggcctggacggcccgactctgttatcgccggcactcgccgacactcctgtgcagccgggtattccgggacgcaccgaagtgcgccttgaccgtgaagccaccgcggagctggccgatgccgcccgcacccgtggcgtcacgatcagcacacttgttcaaatggcttgggctaccacgctttcagcattcaccggtcgtggcgatgtgacgttcggtgtgacggtgtccggcaggcccagcgaactgtccggcgtggaaacgatgatcggcctgttcatcaatacggtgccactgcgggtccgcctggacgcccgcgctaccgtcggcgggcaatgcgctgtcctacaacgtcaattcgccatgttgcgcgaccacagctatctcggtttcaacgagtttcgtgccatcgccggtatcggtgagatgttcgacaccctactggtgtatgagaacttcccgcccggcgaggtggtgggcaccgcggagttcgtcgcaaacggggtgacgttccgtccggtggcgctagagagtttgtcgcactttccggtgaccgtcgccgcgcaccgcagcaccggtgagctcacgctgctagtggaggtgctcgacggtgcgctgggcacgatggcgcccgaaagcctcggcaggcgggtgctggctgtgttacagcgcttggtcagccggtgggatcggccgctgcgcgacgtcgacattctgctggacggcgagcacgatccgaccgcacccggcctgccggatgtgacgacgtcggcacccgcggtgcatacccggttcgccgaaatcgctgcggcacagcctgactcggtggcggtcagttgggcggatggtcagctgacgtaccgggagctggatgcattggccgaccggctggccactgggctgcgccgcgcggacgtgagtcgcgagaccccggtggccgtcgcgctgtcccgtggtccgcgctacgtggccgccatgctggcggtcctcaaggcgggtggcatgatcgtgccgctggacccggcgatgcccggtgagcgtgtcgccgagatcttgcgccagacatcggctccggtggtcatcgatgagggcgtgttcgccgcttcggttggcgctgacatactcgaggaggaccgtgccatcacggtgccggtggaccaggcggcctacgtgattttcacctccggcaccaccggtaccccgaaaggtgtcatcggcacccatcgggcgctgtcggcctacgccgacgaccacatcgagcgcgtgttgcggccggcggcccagcggctcgggcgcccgctgcgaatcgcgcatgcctggtcgttcaccttcgacgcggcgtggcagccgttggtcgcactgcttgacggccacgcggtgcacattgtcgacgaccatcgtcagcgggacgcaggggcgctggtcgaagcgatcgaccgattcggtctggacatgattgacaccacgccgtcgatgttcgcccagctgcacaacgctggactgctcgaccgggcgccgttggcggtgcttgcgctcggcggcgaagccttgggcgccgcgacgtggcggatgatccagcagaactgcgcgcgcacggccatgacggccttcaactgctacgggcctaccgagaccacggtcgaagccgtggtcgccgccgttgctgagcatgcgcgaccggtcatcggacgtccgacctgcaccacccgcgcctacgtcatggactcctggctgcggccggtgcccgatggcgtcgccggcgagctgtatctggcgggcgcccagttgacccgcggttacctcggccgcccggccgagactgcggcgcgctttgtcgctgagccaaacgggcgcggtagccgaatgtaccgcaccggagatgtggtgcgccgcctgcccgacggtggactggagttcctcgggcgcagcgatgaccaggtgaagatccgcggtttccgcgtcgagccgggtgagattgccgcggtgctcaacggccaccatgcggtgcacggttgccatgtgacggcccgcggccatgccagtggcccccggctgacggcgtatgtggcaggcggaccacaaccgccaccggtggccgaattgcgggcgatgctgctagagcggttgccgcgttatctagtcccgcaccatatcgtcgtcctcgacgagttaccgctgactccacacggcaagatcgacgaaaacgctttggcggcaatcaatgtcaccgaaggaccggcaactccgccgcagacaccgaccgagctggtgctggccgaggcgttcgccgatgtcatggaaacctcgaacgtcgatgtcaccgcgggctttttgcagatgggtctagacagcatcgtggcgctgtcggtggtgcaggccgcgcgccgtcgtgggattgcgttgcgggccaggctgatggtggagtgcgacaccatccgtgaactcgcggcggccattgactccgatgccgcatggcaggcaccggccaacgatgccggcgagccgatcccggtgctacccaacactcattggctctacgagtacggcgacccgcgccggctggcacaaaccgaggtcatcaggttgcccgaccggatcacccgcgaacgcctggatgccgtgttggccgcggtcgtcgacggacacgaggtgttgcggtgccggttcgaccgggatgcgatggcccttgtcgcacaaccgaaaacggacattctcagcgaggtttgggtcagcggtgaactggtcaccgcggtggccgagcagactcttggcgcgctggcgagtctcgacccccaggccggccgactgctctcggcggtgtggctgcgcgaacccgacgggcccggtgttctggtgctgaccgcccatgtgctggcgatggacccagcctcctggcggattgtgctgggtgaactcgacgccggcctgcacgcgctggcggccgggcgcgcgcccagcccagcgcgcgagaacaccagctaccggcagtggtcgcggctgctggcgcagcgggctaaggcgctggatagcgttgatttctgggtcgccgaactcgagggcgccgatccgccgttgggtgcccgcagggtggcgccgcagaccgaccgggttggtgagctagcgatcaccatgtcgatctccgacgccgatctgaccgcgcggctgctttcgacgggacggtcgatgaccgatctgctggctaccgccgctgcgcggatggtgaccgcctggcgccggcaacgcggtcaacaaacaccagcaccgctgttggcgttggagacgcatggccgcgcggacgtccacgtcgataagactgccgacaccagcgacacggtcgggctgctcagcgcgatctatccgctgcgcatccactgcgacggcgcgaccgacttcgcgcggatacccggcagcggcatcgattacggcctgctgcggtacctgcgcgccgataccgcggagcgactacgcgcccaccgcgaaccccagctgctgctgaactatctgggtagcctgcacgtcggggtgggagatctggcggtcgaccgcgcactactggctgatgtggggcaactgcctgaacccgaacagccggtgcgccacgaactgacggtgctggcggcgctcctcgggcccgccgacgctcccgtgctagccacgcggtggcgcacgctgcccgacatcctgtccgccgacgacgtcgccacgctgcaatcactgtggcagggcgcgctggcggagataacagcatga

SEQ ID NO: 339 - DNA, 1698 bp, Mycobacterium Tuberculosis
atgccaccgaaggcggcagatggccgccgacccagtcccgacggcggactgggtggctttgtaccgttccccgcggatcgggccgcgtcgtaccgggcggccggctattggtcggggcgaaccctggacaccgtgctctccgatgccgcgcggcgctggcctgaccgcctcgcggtggccgacgccggtgatcgtcccggccacggcggcctcagttacgccgaactcgaccagcgggccgaccgggccgccgcggcgctgcacggcctgggcatcacgccaggcgaccgggtactgctccagctgccaaacggctgccagttcgcggttgccctgttcgcgttattgcgggcgggagcgatcccagtgatgtgcctgcccggtcaccgcgccgccgaattgggccacttcgccgccgtcagcgcggccaccgggctggtggtcgccgatgtggccagcgggttcgactatcggccgatggcgcgcgaacttgttgccgatcaccccaccctgcgccatgtcatcgtcgatggcgatccgggaccgttcgtgtcgtgggcgcagctgtgcgcccaggccggcaccggttcgccggcaccgccggccgatcccggatcgccagcgctgctgctggtctccggcggcaccactggcatgcccaaactcattccacgcacccacgacgactacgtgttcaacgcgacggccagcgccgcactctgtcggcttagcgccgacgacgtctatctggtggtgctggccgccggccacaatttcccgctggcctgcccgggcctgctcggcgcgatgaccgtcggggccaccgccgtgttcgcccccgatcccagcccggaggccgccttcgccgccatcgagcgccacggtgtcaccgtcaccgcgttggttccggcactggccaaactgtgggcccaatcctgtgagtgggagccggtgacaccgaagtcactgcggttgttgcaggttggcgggtccaagctagaacccgaggacgctcgccgggtacgcaccgcgctcaccccgggcctgcagcaggtgttcggcatggcggaggggctgctgaacttcacccgcatcggcgacccacccgaagtggtggagcacacccaggggcggccactatgcccggccgacgaactgcgcatcgtcaacgccgatggtgagccggtggggcccggggaggaaggcgaactcttggtgcgcgggccctacacgctgaacggctattttgctgccgaacgcgacaacgagcgctgcttcgatccggacggcttctaccgcagcggcgacctggtccgccgccgcgacgacggcaatctggtggtcaccgggcgcgtcaaggatgtcatctgccgtgcgggagaaaccatcgccgccagcgacctcgaagaacagctgctgagccatccggcgatcttctcggccgcggcggtgggactacctgaccagtatctgggggaaaaaatctgcgctgcagtcgttttcgctggagctccgattacgcttgcggagttgaacggctaccttgaccggcgtggtgtggccgcgcatacgcgacccgaccagctggtcgcgatgccggcgctgcccacaacgccgatcgggaagatcgacaaacgagcgatcgtccgccagctcggcatcgcgacgggtcccgtgacgacccagcgctgccattga

SEQ ID NO: 340 - DNA, 1353 bp, Mycobacterium Tuberculosis
gtgtccgagctcagcgtcgcgacaggcgccgtcagcaccgcgtcgtcgtccatcccgatgcccgccggtgtcaaccccgccgacctggcagcggagctggcggcggtggttaccgagtccgtcgacgaggattacctgctctacgagtgcgacggccaatgggtcctggccgccggtgtgcaggcgatggtggagctagacagcgacgaactgcgcgtcatccgtgatggcgttacgcggcgacagcaatggtcgggtcgcccgggagcggccctgggcgaagccgtcgatcggctgttgctggaaaccgatcaagcttttggctgggtcgccttcgaattcggcgtgcaccgctatgggttgcagcagcggctggcgccgcacaccccactggcccgggtgttttcgccccgaacccggatcatggtgagcgaaaaggagattcgcctgttcgatgctgggattcgccaccgcgaggccatcgaccgattactcgccaccggggtgcgagaggtgccgcagtcccgctccgtcgacgtctccgacgatccatccggcttccgccgtcgggtggcggtagccgtcgatgaaatcgctgccggccgctaccacaaggtgattctgtcccgttgtgtcgaagtgcctttcgcgatcgactttccgttgacctaccggctggggcgtcggcacaacaccccggtgaggtcgtttttgttgcagttgggcggaatccgtgctctgggttacagccccgaactcgtcacggcggtgcgcgccgacggagtggtgatcaccgagccgttggccggtacccgcgccttgggccgtggtcccgccattgaccgactggctcgtgatgacctggaatcaaactccaaagaaattgtcgagcacgccatttcagtgcgctcttcgcttgaggagattaccgacatcgccgaaccagggagtgctgcggtcatcgatttcatgacggtgcgcgagcgcggcagtgtgcagcacctcggctccaccatcagagcacggttggatccatcgagcgaccggatggccgccctggaagccctttttcctgctgtcactgcatccggaatcccgaaagcagctggcgttgaggccatctttcgcctcgatgagtgcccacgtgggctgtattccggtgcggtggtgatgctttcggcggatggcgggctagacgccgcgctgacgctgcgggcggcataccaggtcggcgggcggacttggctgcgggccggcgccggcatcatcgaagaatcggagccagagcgcgaattcgaggagacttgcgaaaagctatccacattgacgccttatctggttgcacgccagtaa

SEQ ID NO: 341 - DNA, 465 bp, Mycobacterium Tuberculosis
atgacaccgggtttgcttactactgcgggtgctggccgaccacgtgacaggtgcgccaggatcgtatgcacggtgttcatcgaaaccgccgttgtcgcgaccatgtttgtcgcgttgttgggtctgtccaccatcagctcgaaagccgacgacatcgattgggacgccatcgcgcaatgcgaatccggcggcaattgggcggccaacaccggtaacgggttatacggtggtctgcagatcagccaggcgacgtgggattccaacggtggtgtcgggtcgccggcggccgcgagtccccagcaacagatcgaggtcgcagacaacattatgaaaacccaaggcccgggtgcgtggccgaaatgtagttcttgtagtcagggagacgcaccgctgggctcgctcacccacatcctgacgttcctcgcggccgagactggaggttgttcggggagcagggacgattga

SEQ ID NO: 342 - DNA, 1692 bp, Mycobacterium Tuberculosis
atgtccgcgaaggagaacccccaaatgaccactgcacgtcccgccaaggctcgaaatgagggccagtgggcgctgggacatcgcgagccactcaacgccaacgaagagctgaagaaggccggcaacccgctcgacgtgcgggagcgcatcgaaaacatctacgccaaacagggtttcgacagcatcgacaagaccgacctgcgagggcgctttcgctggtggggcctgtacacccagcgtgagcagggctacgacggcacctggaccggtgacgacaacatcgacaagctcgaggccaaatacttcatgatgcgggtgcgttgcgacggcggcgcgctctcggctgccgcgctgcgcacgctgggccagatctcgacggagttcgcgcgcgataccgccgatatctccgaccggcagaacgtgcaataccactggatcgaagtggaaaacgtccctgaaatctggcgacggttagacgatgtcggactgcagaccaccgaggcgtgcggtgactgcccgcgggtagtgctgggctcgccgttggccggcgagtcgctcgacgaagtgctcgacccgacctgggcgatcgaggagatcgtgcgtcgctacatcggcaagcccgacttcgccgacttgccgcgcaagtacaagaccgccatctctggcctgcaggacgtcgcgcacgagatcaacgacgtcgccttcatcggcgtcaaccatcccgagcacggaccaggcctggatctgtgggtgggcggtggactgtcgaccaacccgatgctggcccagcgggtcggcgcctgggttccactgggcgaagtgcccgaggtgtgggcggcggtcacctcggtgtttcgcgactacggctaccggcgactgcgcgccaaggcccggctgaaatttctgatcaaagactggggcatagcgaagttccgcgaagtgctcgaaaccgagtacctcaagcgtccgctgatcgacggtccggcccccgaaccggtcaagcatccgatcgaccacgtcggggtgcaacgactcaagaacgggctcaacgccgtcggagtcgcccccatcgccgggcgggtatcgggcaccatcctcacggcggtcgccgacctgatggcgcgggccggttccgaccggatccggttcaccccctaccagaagctggtcatcctcgacattccggacgccttgctcgacgacttgatcgccggtctggacgcgctggggctgcagtcgcgcccgtcgcattggcgccggaacttgatggcgtgcagcgggattgagttctgcaagttgtcattcgccgaaacccgggttcgagcacagcatttggtgcccgagctggaacgccggcttgaggacatcaactcgcagctcgacgtaccgatcaccgtcaacatcaacggctgcccgaactcatgtgcgcgaattcaaatcgccgacatcggattcaagggacagatgatcgacgacggacacggcggctccgtcgaaggcttccaggtgcatctgggcggacacctcggcctggatgccggattcggccgcaaactgcgccagcacaaggtcaccagtgacgaactcggcgactacatcgaccgggtggtgcgcaacttcgtcaaacaccgcagcgaaggtgaacgcttcgcgcagtgggtcatccgggccgaggaggacgacctgcgatga

SEQ ID NO: 343 - DNA, 429 bp, Mycobacterium Tuberculosis
atgcgcatcgcggacgtcttgcggaacaagggggcggcggtggtgacgatcaaccccgacgccacggtcggggagctgctcgctggcctcgctgagcagaacatcggcgccatggtagtggtcggcgccgaaggcgtggtcggtatcgtgtcggaacgcgacgtggtgcgccagctacacacgtatggtgccagcgtgctgtctcgcccggtcgccaagattatgtcgaccaccgtcgccacctgtacaaaatccgacacggtcgacaagatcagtgtgctgatgaccgaaaaccgggtccgccacgtgccggtgctcgacgggaagaaactgatcggcatcgttagcatcggtgacgtggtgaaatcgcgcatgggagaactcgaggccgagcagcagcagcttcagtcctacatcactcagggctga

SEQ ID NO: 344 - DNA, 720 bp, Mycobacterium Tuberculosis
gtgctgatcgcacgtcccgatatcttatgcagtcgcggtccggaggcaatgcgggccaaagccgccgatttggacttggctgcggcggcaaagacggtcggagtgcagcccgccgccgatcaggtggcggcggcaattgccgcaatattgctgtcacacgcccagatctaccaggacatcagcacacagatggcggcattccacgaccagctcgtagagaaccgcacggcagatagcacgtcgtacgccagcgccgaggccaacgcccagcagagcctgctcaatgcgatggatgcaccgagctggcaacagcgccgagaaaccgtcggcgaggtggggctcccagcggacccagcgggatccggcacggcgacggcggcagtggcggcggcgacgacggcgcgggcaggaagccgttcggccgcccaggcaaccgtggcgcctatcggcgggctgaaactccgccgcgaatctgcgctaagccagccgggtgatctccaccaccacgtcgaggtcggtgacgccctccccagagtagatccctttcagcggggaaacgtcggtgtagtcgcggcctacacccacactgatgtattgctcggtgatctcattgtcattggtggggtcgtagtgccaccatccaccggtccaggcctgaacccaggcatggctgcgcccgtctaccgtctttcccaccacggcatcacgcttagggtgtag

SEQ ID NO: 345 - DNA, 1545 bp, Mycobacterium Tuberculosis
atgggcttcggcgcgtcccgtttggacgtacgcctggtcccggcggcgctggtcagctggattgtgacggcggccgggatcgtgtggccgatcggcaacgtgtgtgccttgtgctgcgtcgtggtggccctcggcggcggcgcactgtggtggtgtgtggcgcgccggtcgtggcacgctccgcgactgggttcgatcagcgccggcctggtcgcggtcggtatggtgggcgcggggtacgggcttgcggtcgcgttgcgctccgaggcggtcgatcgccacccaatcaccgtggcatttggcacctccgcgctggtcacggtcacccccagcgagagcccagtgtcgctggggcggggccggttgatgttccgggcgacggttcaacggctgcgggatgacgagacatccggccgggtagtggttttcgcgcgagcgctggacttcggcgagctgatggtcggacagcccgtccagttccgcgcgcgtatcagtcgcccggcgcgtcacgacctgacggtcgcggtgttcaatgcgaccggtcggccgaccgtgggccgtgccggcccggtacaccgcgccgctcacatcgtccgccatcgattcgcggccgcggttcgtgaggtgctgcccgctgaccaggccacgatgttgccggccctggttctcggcgatacctcgacggtcaccgccttaaccagccgcgagttccgtgcggcgggcctgacgcacttgacggcggtctcgggggccaatgtcacgatcgtgtgtgcggcggcgctggtttcggcacggttgatcggaccgcgtgcggccgtggtgtgcgcggccgtcgcgttggtggcattcgtcatcctggtgcagccgacggccagcgtgttgcgggcagctgtgatgggcgccattgccctcgtggggatgctgtctgcgcgccggcggcaggcgattccagctttgtcgggtagcgtgctggttttgctggctgccgctccccatcttgctgtggacatcggcttcgcgctgtccgtggcggccacgggtgcactggtcgtcatcgcgccggtttggtcacgccgcttggtcgaccgcggatgtccgaaggtgctggccgatgccctcgcagtcgcggcggccgcgcagctggtgacggcgccactggtggccgccatctccggccgggtcagtctggtggccgtggtggccaatctggcggtggcggccgtgatcgcgccgatcaccgtgctgggcagcgttgcggccgtgctggtcgtgccgtggccggccggcgcgcaggtgctgatccggttcaccgggcccgaagtgtggtgggtgttgcgcgtggcgcattgggcgtcgggtgtgcccgcggcgaccgttccggtggccgcaggtctgcccggcgtactgctggtcggtggcgccaccgtgttcacggttgcgcagtggcgctggcgctggtttcgcgcggccatgtgcaaaacgatggcggtggccgtcatatgtctgcttgcctggtcgctgtccgggctggtcggcccttcgtga

SEQ ID NO: 346 - DNA, 894 bp, Mycobacterium Tuberculosis
atgcgaacagaactgcccgccgagcgactgcaaaggcggctcggtgccgtcccggatatcgactcgcacgccgcatctgcacacttagacccggagccacacgatccaacggacgacggtccagaccacgacgagccacgcgacgatccgaactcgctgctgccgcgctggcttcccgacacttcccgtgggcaaggttgggcggacaggatacgcgcagatccgggccgtgccggcgccgtcgcattggcggtgatcgccgccctcgcggtgctggtgacggtattcaccttgatccgcgaccggactgagccggtaatgtcagccaaacttcctccggtagagccggtttcgccgacgaaccctaggtcgtcggcaagcccgggctcgccggaccgttccggcctgccggtggtggtcagcgtggttggcctggtgcacaccccaggactcgtcaccctggcgccgggcgcgcggatcgccgatgcgctacaggccgccggcggagcggtagacggcgcggacaccgtcggactgaacatggctcggcagcttggtgacggtgagcagatcgtggtcgggctagctccgccctcgggacagccgagggtgctgggcagctcggtcggtgcggggacgccgggaccggcgggtacctcgggcacagccacgacaggccctaagacagctcctaagacagctgaggtgctcgacctcaacactgcgaccgtggagcagctggacgccctgcccggcatcgggccggtcaccgccgcagcgattgtggcgtggcggcagcgcaatggtaggttcaccagcgtcgaccagcttgccgacgtcgacggcatcggtccggcgcggctggacaagcggcgcaatctggtccgtgtctga

SEQ ID NO: 347 - DNA, 744 bp, Mycobacterium Tuberculosis
atgtcctctaggcgcgggcgcaggcccgcattgttggtcttcgctgactcgctggcctactacgggcccaccggcggcctgcctgccgatgacccccgtatctggcccaatattgttgcttcccaactagattgggatttagagctgattggccgcatcggctggacctgtcgggatgtctggtgggcggcaacccaggatccgcgcgcttgggcggcgttacccagggccggagcggtgatcttcgcgaccggcggaatggattcgctgccgtcggtattaccgacggcgctgcgtgagctcatccgctatgtacgtccgtcttggctgcgacggtgggtccgcgacggctacgcctgggttcaaccgcgactgtcgccagtggcccgtgcggcgttgccgccgcacctgaccgctgagtaccttgaaaagacccgtggtgcaattgatttcaatcgtccgggcataccgatcatcgcatcgctgccctcggtgcatatcgccgagacctacggcaaggcccatcacggccgcgcaggcacggtggcggcgatcacggaatgggcacagcaccatgacattcctctagttgatctcaaagccgctgtcgcagaacagatattgagtggatatggtaatcgtgatggcattcactggaattttgaagcccaccaggcggtcgccgaactgatgctcaaggcactggccgaagccggggtgccgaacgagaaatcgcgcggctga

SEQ ID NO: 348 - DNA, 1443 bp, Mycobacterium Tuberculosis
gtggccgcccgtcgtattcgtgctgcccggccactcgccccgcatgggctgcccggacacttggtgggctttgtggaagcgctgcgtggcagcgggatttcggtgggcccgtcagagacggtggatgccggccgggtgatggccaccctcgggctgggtgatcgtgaggtgttgcgggagggcattgcttgtgcggtgctgcgccggcctgaccaccgcgatacctatgacgccatgttcgacctgtggtttcccgcggcactgggggctcgggcggtcatcaccacggaagacgagtcggcaggctccgggggtttgccgcccgatgatgtcgaggctatgcggcagctgctgctggatctgctggccaacaaccaagacctggccggcaaggacgagcggttggtggagatgatcgcgcggatcgttgaggcctatggcaagtacagttccagccgcggtccgtcgttctcgtcgtatcaggcactcaaggccatggcgctggacgaactggagggcaagctactggcgggcctgcttgctccctacggcgatgagcccacagccacccaggaacagattgccaaagcgcttgccgcacaaaagatcgcgcagctgcgcagaatggtcgacgccgagaccaagcggcgcacagccgagcaactcggccgcgagcacgtccagatgtacggaattccacagctttccgagaacgtcgagtttctgcgtgcctcgggtgagcagctgcgccagatgcgccgggtggtggccccgttggcccgcaccctggcgacccggttggccgcccggcggcgccgcgcccgcgcgggatcgatcgatctgcgcaagacgctgcgcaagtcgatgtccaccggcggcgtgccgatcgacctggtgttgcacaaaccccgcccggcgcgcccggaactcgtcgtgttgtgcgacgtgtcgggctcggtcgcgggcttcagccacttcacgctgctgctggtacacgcgctgcgccaacagttctcccgggttcgcgtcttcgccttcatcgactccaccgacgaggtgacccatatgttcgggccggaatcggacctggccatagcgatccagcggatcacccgggaggctggtgtgtatgcccgcgacggccattccgactacggcaacgcgttcgtctcgttcatgcagggcttcccaaatgtgctgtcgccgcgcagctcgctgctggtgcttggtgacgggcgcaccaactaccgcaacccggccaccgacgtgctggccgacatggtgaccgccagccggcacgcgcactggctcaacccggagcccaagcatctgtggggcagcggtgactcggcggtgccgcgctaccaagaggtgatcacgatgcacgaatgccgatccgccaagcagctggccacggtgatcgaccagctactgccggtgtag

SEQ ID NO: 349 - DNA, 876 bp, Mycobacterium Tuberculosis
gtgaccgtgcccgcccggcccacgccgctgttcgccgacatcgccgacgtctcgcggcggctggccgagaccggctacctgcccgacactgccaccgcgacggcggtctttctcgccgaccggctcggcaagccgctgctggtggaaggccccgccggggtcggcaagaccgagctggcgcgcgccgtggcgcaggccactggatccggtctggtccggctgcagtgctacgagggcgtcgacgaggctcgcgccctgtatgagtggaaccacgctaagcagatcctgcgtatccaggccggctcgggagattgggaggccaccaaaaccgatgtgttcagcgaagagttcctgctgcagcgtccgctgctgaccgctatccggcgcaccgagcccaccgtgctgctgatcgatgaaaccgacaaggccgacatcgagatcgagggcctgctgctggaggtgctgtccgacttcgcggtgaccgtccccgaactgggcaccctgaccgccacccgggcgccgttcgtgctgctgacctccaacgccacccgtgagctgtccgaggcgctcaagcgtcgctgcctgtacttgcacatcgacttcccgacccccgagctggagcgtcgcatcctgttatcccgagttcccgagctgcccgagcacttcgccgaggagttagtgcgcatcatcggcgtgctgcgcggcatgcagcttaagaaggtgccatcgatcgccgagaccatcgactggggtcgcaccgtcttggcactgggactggacaccatcgacgatgcggtcgttgccgccacgctcggcgtggttctcaagcaccaatccgaccagcaacgggccaccggagagctcaggttgaactag

SEQ ID NO: 350 - DNA, 588 bp, Mycobacterium Tuberculosis
atgccactgctaaccattggcgatcaattccccgcctaccagctcaccgctctcatcggcggtgacctgtccaaggtcgacgccaagcagcccggcgactacttcaccactatcaccagtgacgaacacccaggcaagtggcgggtggtgttcttttggccgaaagacttcacgttcgtgtgccctaccgagatcgcggcgttcagcaagctcaatgacgagttcgaggaccgcgacgcccagatcctgggggtttcgattgacagcgaattcgcgcatttccagtggcgtgcacagcacaacgacctcaaaacgttacccttcccgatgctctccgacatcaagcgcgaactcagccaagccgcaggtgtcctcaacgccgacggtgtggccgaccgcgtgacctttatcgtcgaccccaacaacgagatccagttcgtctcggccaccgccggttcggtgggacgcaacgtcgatgaggtactgcgagtgctcgacgccctccagtccgacgagctgtgcgcatgcaactggcgcaagggcgacccgacgctagacgctggcgaactcctcaaggcttcggcctaa

SEQ ID NO: 351 - DNA, 291 bp, Mycobacterium Tuberculosis
gtgggcctgcgcgacgctgacgagcggtgggacacggttggccaagcgatcggtctgtttctgcgcggccacaccctgcgcaccgcagctccgacggcgctgatcgtgggtaccgtgctatgtgcggtgaatcagggtgccacccttgccgagggcgccgcgacgatcggcacgtgggtacggatggtgatcaattatttggtcccgttcctggtggctagcgtcggctacctcggtgcgcggcgcggtgtccggcgtgcgagcggacgttctgatccatcagcacaatga

SEQ ID NO: 352 - DNA, 1446 bp, Mycobacterium Tuberculosis
atgaacctgctcgactcgacatggttctactgggccgttggcattgcgatcggattgccggccgggctaatcgttctcaccgaactgcacaacatactcgtccgacggaacagccatctggccaggcaggcaagtctgctgcgaaactacctgctacccctgggcgcggttttgctgctgcttgtcaaggcatctgaagtcccggccgaggaccccaccgtgcgggtgctcacgacagcgttcggatttctggtgctggtgctgctgctgtcgttactgaatgccaccctgtttcagggtgcgccccaacagagctggcgcaagcggctacccgccatcttcgtcgatgtcgcgcgcttcgcgctgatcggcataggtttggcggtgatcctgtcctacatctggggggtgcgggtcggtggactgttcgccgcgttaggtgtgacgtcagtcgtcatcggcctgatgctgcagaactccgtcggccagatcgtgtcgggcttgttcatgctgttcgaacagccctttcggatcgatgattggttggaaacacccacagcccgcggacgagtcgtcgaggtgaactggcgggctgtccatatcgacaccggcagcggactgcagatcatgcccaactcgatgttggccaccaccgcgtttaccaatctcagccggccggccggggcgcacgaatgctcgatcacgaccacattttccacgtccgatcccccggacaaggtatgcgccatgctgaacagggctgccagcgcgctaccgcatgttaagcccggggtcgtgcccgccacaattgcccgaggagccgccgagtatcgaacgacggtcaggctgacatcaccggccgacgaaggcccaacgcaggcaacgtttctgcgctgggtctggtacgccgcgcgtcgggaagggctacacctcgacgaggccgacgacgagttctcgacggccgaacgtgtggagtccgccctgcgcacggtggtggggcccgagctgcgactgagctctagcgatcagcagtcgctggctcggtacgcgaggctggtgcgctacggcactgatgagatcgtgcagcacgcgggtgtggttcccatgggtatcaccttcgtgatcgccggcagcgtgcggctgacggttacgaccgatgacggatccgtggttgcgattgccaccctcaaaaagggcacgtttctgggcttgactgcgctgactcggcaacccgaccccgccggtgcggtagcgctggaagaggtgaccgcgctgcagatcggccgggagcaccttgagcaggtcgtgatgaacaagccgatgctgctgcaggagctgggtcgggttatcgacgagcggcaaaggaaggcgcaacaggcaattcgccgcgacttgcaccaatccccagcggcggccggcgagcatcgtgggcctgcgcgacgctga

SEQ ID NO: 353 - DNA, 915 bp, Mycobacterium Tuberculosis
atggcaaacgccagtgagactaacgtcggccccatggcgccccgggtgtgcgtggtaggcagcgtgaacatggacctgacgttcgtggtggacgcgcttccgcgccccggcgagacggtgcttgcggcgtcgttgacccgaacgccaggcgggaagggcgccaaccaggcggtggccgcagcgcgcgcaggcgcgcaggtacagttctccggtgcattcggcgacgatccagccgccgcccagctgcgggcccacctgcgcgccaacgccgttggactggacaggaccgtcacggtgcccggaccgagcgggacggcgattatcgtggtcgatgccagcgccgagaacaccgtgctggtggcgccgggtgccaatgcacatctgactccggtaccctcggccgtcgccaactgcgatgtactgttgacccagttggagattcctgttgcaaccgcgctggcagccgcgcgggcagcccagtcggccgatgcggttgtcatggtcaacgcctccccagccggccaggatcgaagctccttgcaggacttggccgctatcgccgacgtggtgatcgccaacgagcatgaggcaaacgactggccgtcgccaccaacacatttcgtgatcaccctgggtgtgcgcggtgcccggtacgtcggcgcggacggggtgttcgaggtacccgccccaacggtaacgccagtggataccgccggcgccggcgacgtatttgccggggtccttgctgcgaattggccgcgcaacccaggttcgccggccgagcgactgcgcgcattgcggcgggcctgcgctgcgggtgcgctggcaactttggtgtccggtgtcggcgactgcgcaccggccgccgccgcgatcgatgcggccctgcgagccaaccgccacaacggttcatga

SEQ ID NO: 354 - DNA, 504 bp, Mycobacterium Tuberculosis
atgacgcatcggagttcacggttggaggtggggccagtggcacgtggtgacgttgcgacgattgagcacgccgagctgccgccgggttgggtgctgaccaccagcggacggatctcgggggtcaccgagcccggggaactgtccgtgcactacccgttccccatcgcagatctcgtcgccctggacgacgcgctgacctacagctcgcgggcgtgtcaggtgaggttcgccatctacctcggcgacttgggtcgtgacaccgccgcgcgggcccgcgagatcttgggcaaggtgcccacgccggacaatgctgtgctgctcgcggtctcgcccaaccagtgcgccatcgaagtggtctacggctcgcaagtccgcggccgcggtgccgagtcggcggctccgctcggggttgccgccgcttcctcagcgttcgagcagggtgagctggtagatgggctgatcagcgcgatccgcgtgctcagcgcggggatcgcgccgggctga

SEQ ID NO: 355 - DNA, 4875 bp, Mycobacterium Tuberculosis
atgacgatcgatcccggggctaagcaggatgttgaggcgtggaccacgttcaccgcgagtgcggacattcctgactggatctcgaaggcctacatcgacagctatcgaggaccgcgcgacgactcgtcggaagccaccaaggccgccgaggccagttggcttccagcctccctgctgacgcccgccatgctgggcgcacattatcggcttggccggcaccgcgcggccggtgaaagctgtgtcgccgtctatcgggcggacgatcccgcggggttcggtccggcgctgcaggtggtcgccgagcacggcggcatgctgatggattccgttacggtgctgctgcaccggcttggaatcgcctacgcggcgattctgaccccggtgttcgacgtgcaccgcagccccacgggagagctgctgcgcatcgaaccgaaggccgagggcacgtcgccgcacctgggtgaggcctggatgcacgtagcgctctcgcccgccgttgatcacaaaggcctcgccgaggtggagcggttgctgcccaaggtgctggccgacgtccagcgggtggccaccgacgccacagcgctgatcgccaccctgagcgagctggcgggagaagtcgaatccaatgccggcggccgattttccgcgcccgaccgacaagacgtcggggaactgttgcgttggctgggtgacgggaacttcctgctgctgggctaccaacggtgccgggtggctgacgggatggtctacggcgaggggtcaagcggtatgggcgtcctgcggggccgcaccggttcgcgtccccggctgaccgacgacgacaaactgctggtgttggcccaagcgcgggtcggcagctacctgcgttacggcgcctatccctatgccatcgcggtccgcgaatacgtcgacggcagcgtggtcgagcaccgcttcgtcgggctcttcagcgtcgcggccatgaatgcggacgtgctggagatcccgacgatctcgcgccgggtccgcgaggcgctggcgatggccgaaagcgatcccagccacccaggccaattgctgctcgacgtcatccagaccgtcccgcgaccggagctgttcaccctgagcgcgcagcgcctgctgaccatggccagggccgtggtggacttgggatcgcaacggcaggcgttgttgttcctgcgcgcggatcggttgcagtacttcgtgtcgtgcctggtctacatgccccgagatcgctacaccaccgccgtgcgcatgcaattcgaggacatccttgtccgcgagttcgggggaacacgactggagttcaccgctcgggtcagtgaatcaccttgggcactcatgcatttcatggtgcggctacccgaagtgggtgtggcaggagaaggggcggccgccccgccggtggacgtttccgaagccaaccggatccggatccagggtctgctgaccgaagccgcgcgaacctgggccgaccgtttgatcggcgcggcggcggcggctggctccgtcggacaggccgacgctatgcattacgctgccgccttctccgaggcctacaaacaggccgtcaccccggccgatgccattggcgacattgcggtcatcacggagctgaccgacgattcggtcaagctggtgttttccgaacgcgacgagcagggtgtcgcccagttgacctggttcctcggtgggcgcaccgcttcgctgagccagctgctgccgatgctgcaaagcatgggagtcgtggtgctcgaagagcgaccgttctccgtcacccggccggacggtctgccggtctggatctatcagttcaagatctcgccgcatcccacgatcccgttggccccgacggttgccgagcgggccgcgaccgcgcaccgattcgccgaggcggtgaccgcgatctggcacggccgggtcgaaatcgaccgattcaacgagctggtgatgcgtgccgggctgacttggcagcaggtcgtgctgctccgtgcctacgcgaagtacctgcgccaggcgggcttcccgtacagccagtcctacattgaatcggtgctcaacgagcaccctgctaccgttcggtctttggtcgatctgttcgaagcgcttttcgttccggtgccgtcggggtcggcgagcaatcgcgatgcccaagcggccgctgccgctgtcgccgcggacatcgacgcgctggtgagcctggacaccgaccggatcctgcgcgccttcgcgtcgttggttcaggccacgttgcgcaccaattactttgtgacacgccagggttcggcccgctgccgtgatgtattggcgctgaaactcaatgcccagttgatcgacgaacttccgctgccgcgtccccggtacgagatttttgtgtattcgccccgcgtcgaaggcgtgcatctgaggttcggcccagttgcgcgtggcgggttgcgctggtcggaccgccgtgacgatttccgaaccgagattctcggattggtcaaggcgcaagcggtgaagaacgccgtcatcgtgccggtcggggccaagggcgggttcgtggtcaagcgtcccccgctgcccaccggcgaccccgccgccgaccgcgacgccacccgcgccgaaggggtcgcctgctatcagctgttcatctccgggttgctcgatgtcaccgacaacgtcgatcatgcgaccgcaagcgtcaaccccccgcccgaggtggtgcgacgtgacggcgacgacgcctacttggtagtggccgccgacaaaggtactgccaccttttccgatatcgccaacgatgtcgccaagtcctatgggttctggctgggcgacgcgttcgcctcgggcggatcggtgggctacgaccacaaggccatgggcatcaccgcccggggggcctgggaggccgtaaaacggcatttccgagagatcgggatcgacacccagacccaggatttcaccgtcgtgggaatcggcgacatgagcggcgacgtattcggcaacggcatgttgctgagcaagcacatccggctgatcgccgccttcgaccaccgccacatcttcctcgaccccaaccccgatgccgcggtgtcgtgggccgaacgccggcggatgttcgagttgccccggtccagctggagcgactatgacaggtctctgatcagcgagggcggcggggtgtacagccgcgaacagaaagccatcccgctcagcgcgcaggtccgcgccgtcctcggcatcgacggctcagttgacgggggggccgccgagatggccccgcccaaccttattcgggcgattctgcgggcgccggtggacctgctgttcaacggcggcatcggcacttacatcaaggccgagtcagagtcggatgctgatgtcggcgatcgcgccaacgatccggtgcgagtcaacgcgaatcaagtgcgcgccaaggtcattggcgaaggtggcaatctcggagtgacggcgttgggccgtgtcgaattcgatctgtccggcggccggatcaacaccgacgcgctggacaactccgccggcgtggactgctcggaccacgaggtcaacatcaagatcctgatcgactcgctggtgagcgccggcacggtcaaagccgacgaacgcacacagctgctcgagtcaatgaccgacgaggtagcgcaactggtgctcgccgacaacgaagatcagaacgacttgatgggcaccagtcgcgccaacgcggccagcctgctgccggtgcacgcaatgcagatcaagtatttggtggctgagcgcggggtcaaccgcgaattggaagcgctgccgtcggagaaggagattgcccggcgctccgaggccggcatcgggctcacctcgcccgaactcgccacgctgatggcgcacgtcaagctggggctcaaagaggaggtgctagccaccgaactaccggatcaggatgtcttcgcttccaggttgcctcgttatttcccgacggcgctgcgcgaacggttcaccccggagatccgttcccaccagctgcgccgcgagatcgtcaccaccatgctgatcaacgatctggtggataccgccggcatcacctatgcgttccggatcgccgaagacgttggtgtcacgccgatcgatgccgtgcgcacctatgtcgccaccgatgccatcttcggtgtcggtcacatttggcgccggatccgtgcggcgaacctgccaatcgcgctgtcagacaggttgacgctggacacccgtcggctgatcgaccgtgccggacgctggctgctcaactaccgtccgcagcccttggccgtcggcgccgagatcaaccgattcgcggccatggtcaaggcactgacaccgcgcatgtcggagtggttgcgtggtgatgacaaggccatcgtcgaaaagacagctgcggaattcgcatcgcagggtgtgcctgaagacttggcctaccgtgtctcgaccggcctgtaccggtacagcctgctcgacatcatcgacatcgccgacatcgccgacatcgacgccgccgaggtcgctgacacctatttcgccctgatggaccggctgggcaccgatggcctgctgaccgcggtatcccagctgccccgacacgaccgctggcattcgttggcgcgcttggcgattcgcgacgatatttacggtgcgctacggtcgttgtgtttcgacgtgctggccgtgggggaacccggcgagagtagcgagcaaaagatcgccgagtgggaacacctcagcgcctcccgggtggcgcgggcacgtcggacactcgacgacatccgtgccagcggccagaaggatctggcgacgttgtcggtcgccgcgcggcagatccgccgcatgacacggacaagcgggcgaggaatctcggggtga

SEQ ID NO: 356 - DNA, 1677 bp, Mycobacterium Tuberculosis
atggctgagttcatctacacgatgaagaaggtccgcaaggcgcacggcgataaggtgatcctcgacgacgtgacgttgagtttctatccgggcgccaagatcggtgtcgtcggccccaacggggccggtaagtcgagcgtcttgcggatcatggccggtttggacaagccgaacaacggcgatgccttcctggccaccggcgccaccgtgggcatcctgcaacaggaaccgccgctgaacgaggacaagaccgttcgcggcaatgtggaagagggcatgggggacatcaagatcaagctcgaccgcttcaacgaggtcgccgaattgatggccaccgactacaccgacgagctgatggaagagatgggtcggctgcaagaggaactggaccacgccgacgcgtgggacctcgacgcgcagctcgagcaggccatggatgcgctgcgctgtccgccggccgacgagccggtaaccaacctatccggtggcgagcgtcgccgggtggcgctgtgcaaactgctgttgtccaaacccgacctgttgttgctcgacgagccgaccaaccacctagacgcggaaagtgtgcagtggctcgaacagcatctggccagctaccccggtgcgatcctggcggtcacccacgaccgttacttcctggacaacgtcgcggaatggatcctggagctcgatcgtggccgcgcctacccctatgagggcaactactcgacctatctggagaaaaaagccgagcggctcgcggtgcaaggccgcaaggacgcgaagctgcaaaagcggttgaccgaggagttggcttgggtccggtccggggccaaggcgcgccaggccaaaagcaaggcgcgcctgcagcgctacgaggagatggcagccgaggcggagaagacccgcaagctcgacttcgaggagattcagatcccggtcgggccccgcctaggcaacgtggtggttgaggtcgaccacctcgataagggctacgacgggcgcgccctgatcaaggacctgtcgttcagcttgccccgcaatggcatcgtcggcgtcattgggcccaacggggtaggcaagaccacactgttcaaaaccatcgtcgggctcgagacaccggacagcggcagcgtcaaggtcggcgagaccgtcaagctgagttacgtggaccaggcccgtgctggcatcgatccgcggaagaccgtctgggaggttgtctcggacggtctggactatatccaggtcggtcaaaccgaagtgccgtcacgggcctacgtgtcggcattcgggtttaagggaccggaccagcaaaaaccggccggtgtgctatccggcggggagcgcaacaggctcaaccttgcgttgacgctcaaacagggcggcaacctgattctgctcgacgaaccgacgaacgacctggatgtcgagactctgggttcgctggagaatgctctgctgaacttccccggctgcgccgtggtgatttcgcacgatcgctggtttcttgaccgcacgtgcacgcacatcctggcgtgggagggtgacgacgacaacgaggcgaagtggttctggttcgagggcaacttcggcgcctacgaggagaacaaggtggaacggctcggtgtcgacgccgctcgaccgcatagggtcacccaccgcaagctgacgcgcggctaa

SEQ ID NO: 357 - DNA, 4983 bp, Mycobacterium Tuberculosis
atgtcatatgtgatcgcgacgccggagatgatggcaactgcggcttttgatctggcgcgtattggttcgcaggtgagcgcggctagtgcggtcgcggcgatgccgacgacggaagtggtggccgccggcgccgacgaggtgtcggcgggcatcgcggcgttgttcagcgcgcacgctcaggagtatcaggcgctaagtgcgcaggccgcggcgtttcacgaccagttcgtgcacacgctgaccgcggccgcgaggtggtacacggccaccgagatcgccaacgccgcggcgatgcgagtcgtgctcggagccgtgaatgcgcccacccagacgctactgggacgcccgctgatcggcgatggtgcgcacgggacagcgcctgggcagcccggtggggccggtggattgttgttcggcaatggcggcaacggcgctgccggtgccgtcgggcaggtgggcggcgccggcggggcggccgggttatttgggatcggcggcgccggtggcgcgggcggggcgggcgcacccggaggtaccggcgggacgggtggatggctggcgggtgggggcggcgtcggcggtatgggtggggctggtggtggcgccggcggggcgggtggcaacgcgggcctgttcggcaacggcggcgccggtggtgccggtggggctggtggtggcgccggcggcgcgggcggtaacgcggggtggtttggtcatgggggcgctggcggcgtgggtggtgtaggtgcggccggggccaacggtgctacgcccggtcaggatggggcggctggtgttgccgggtcggacgacggtgccggcggtgacggtttggcagggtcggacgggggcgatggcggtgccggtggggtgggcggcaacggtggtcggggagggtggcttctcggtaacggcggcgccggtggcgttggcggtgtcggcggggccggtggtgccggtgcggccggcggtgccggcggtgccggggctaccggaataaatgggccggccggtatctcggcggccggcggtgacggcggcgccggcggcaatggcggtgccggcggaaacggcggcgtgggcggcgccgggggtgctggcgggtcggctggactattggggtatgtcggccgggccggagacggcggggctggcgggggtggggggctgggtggagcgcctggtgacggcggtgccggcggcaacggtggcagttggctggccgccggtgacggcggggccggcggtcacggtggcgacccgggcctgggtggggctggcggagccgggggggcgtcgggcggcgccggtgctcgcgcgggggccaatggtctggcggccggcaacgacgggccggtcagcggcggcaacggcggcaaaggtggcaatggcgcccacgcaccggtcgccggcggtcatggcggtaacggcggtgccggtggcaacggcgggttggtcggtgacggtggggccggcggtcatggcggtgacggagccgcgggtgccggctatgccgatatgacggcgatcttcctgggttcatccggtacccccggtgaggatggaggtaacggcggggccggtggggccggcggcgcgggtggggcccacgccggcgatggcggggccggcggtgccggcggcaacggtggggccggcggggccggtggtaacggagctcacggtttcaatgctgtgctcgtatctgacggcggcaacggtggtgatggcggagccggcggtcgcggcggtgacggtggggccggtggggctggcggtgacgcacctgcgggtcgggcgggcagccagggtgttggcggggacggtggtgccggcggggctggtggggcgcccggtaacgggggcagcggtggccgcggcgacatggctttcaaggatggtgacggtggggccggcggcgatggtggtgacccaggcgccggtgggaagggtggcgccggcggcgccggcgccaccgagggtgtgaccggcgcgaccggcgctaccgtgcacagtggtggcaacggcggcaagggcggtaacggcgccgacgccaccgtggctggcgcgaacggcggcaagggcggtgccggtggtaacggcgggttggtcggtgacggcggggccggcggcgacggtggtagcggcgcggccggtgcgaatggcgcgaacgtaggtgaggacggcgccgacggcaccctctcggggcaaccgggcgaaggaagcgaggccaacggcggtcaaggcggcgttggcggtggcggcgcgggcggtgccggcggtgacggtggtgccgggagttcggcgttaggtagtggcggcaacggcggtcgaggcgatgcggggcaggccggcggcgcgggcggtgccggcggagccggtggcgccggtgggtcggtgtcgggcgacggtggacccggtggcaagggcggggccggcggtgcgggtggtgccggagctagtggtggcggcggcggcaagggcgcctccggcgccgacagcgctgaggccgttggaggcgccggcgggaaaggcggcgacggcggtgtcggcggcgttggcggtgacggcgggcccggcggtgatggcggcgccggcggggccgcacccgcgggtcaggtcggcagccacggtgtcggcggcgttggcggtgacggcgggctcggcggagccggcggcaacggcggtgacggcggtcatggcagtgatggcggggacggcggtgacggcggtgaccccggcgcgggaggcctcggcggcttgggcggcgacagcggcaacggcacccgcgcggccagcggtgtggacgccagcgaccacgggcccggcagcggcggcaacggtggtaacggtggcaacggtgcgcaagccagcgtcgcgggcggcgccgggggcaacggaggcgacggcggcaatgccggccgggtcggcgatggtggcgccggcggcaatggtggcgatggcgcggccggcgccaacggggccaattcgggcgcgcctggttcagatgccctcgccctcggccaaccgggaggcaacgggggtcagggcgacgcggggcaggccggcggtgccggtggtgccggtggtgccggtggcgccggtgggtcggtgtcgggtgacggcggtgccggcggcaacggcggggccggcggcaacggcggtgtgggcgctagcggtggggccggggccaggggcgccaacggtatcgacagtatcggcggcaccggtggggccggcggtggtggcggcgatggcggtgccggcggggtcggtggacatggcggggacggtggggtcggcggggccgcaccttcggggacggtcggcagtcacggcaccggtggggtcggtggcgacggcggactcggcggcgccggcggcgttggcggggccggcggcaacggcggcattggtatcaccgtcggcggcgccggcggagcgggcggtaacggcggtgaccccggcgcaggcggtcgcggcggtctggggggtgacagcggcaacggcacctccgcggccaacggcgtggacgccagcaaacacgggccactgaccggcggcgacggcggcgtcggcggcaacggtgccaaggccgccgcggccggcggcgacggcggccagggcggtgacggcggcaacgccgggctattcggggacggcggagccggtggtgatggggccgacggcaccgctgccgaagctctcggcggtgatggcggggccggtggggctggaggcaagggcggtgacgccggcgacatcggtgacggcggtgacggcggcaagggtggcgacggcgcgcacggtgccctcggagggctcaccgttgctggcggcaacggtggggctggtggcgccggtggggctggtggcgccggcggagcatttctgggcgacggcgggaacggcggagccggcggccaaggtggggctggccggggcggcagccccggcggcggcggcggggttggtggacacggcggggcgggcggcgacgccgggatgaacggcggcggcggaaccggcggccagggaggcaacggcgcggccggtggcgcgggttggtcgcccgactccgacctaaagggcttcgacggcttcgacggcggcagcggtggggcgggaggcgacggcggggccggtggcgccggcggaactcagaccggcgacggtggtgacggcggggccggaggcctaggcggggctggtggggtcggcggtaacggcgttgacggctttgacattaacgaaacgacgggccgcgacggcggcgacggcggcgacggtggctacggcgggtggggcggcgccggcggaaacggcggggccggcgggtcggcacccgccggcgaggtcggcaatcgaggcgttggcggggacggcggtgacggcgggtcgggcggggacgctggtaatggtggcttgggcggtgacggctttacctatctcgcggattttgacggagagcctggcggcgacggaggtgacggcggcgacggcgggtggggccgccccggcggacaaggcggtttcggttccacaagtggcgcgcacggcaaggccggcttcggcgcccccggcggtgacggaggcgacggcgggaacggcggtcacggtggggacggcaacggcagctttgctgatgcaggcgacggcgggccgggtggcaacggcggcaacggcggcttgggtggggccgggcgagacggtggcgcccccggtggtgacggaggcgacggcgggaccggcggctccggcggcttcggcgcccctccgcctcgcagcatcggcggcggtgacggcggggacggcgggcgcggaggtgacggcggacgcggtgccggtggcttgacctccggcggcgtcggctcgtcgggcgagtcgggtggctccggcaacgggaggggcgaccctggctccggcggttccggcggtgaaggcggcgaaggcggcccctccatctccgttaacgtcacgtag

SEQ ID NO: 358 - DNA, 1182 bp, Mycobacterium Tuberculosis
atgagcggtgaggacagcatcaggtctttcccggtgcccgacctcggcgagggactgcaggaagtgacggtgacgtgttggagcgtcgccgtcggcgacgatgtggagatcaaccagacgctgtgttcggtggagaccgccaaggccgaggtcgaaatccccagcccgtatgccggccggatcgtcgagttaggcggcgccgaaggcgatgtgctcaaagtgggcgcggagctagttcggatcgacaccgggcccacggcagttgcgcagcctaacggtgaaggagcggtccccacgttggtcggctacggtgccgacaccgcgatcgaaaccagtagacggacaagccggccgctggcggcaccggtagtgcgcaagctggccaaagagttggcggtcgacctggccgcattgcagcgtgggtcgggcgccggcggtgtgatcacccgggccgatgtgctggccgctgctcgaggcggcgtcggagccgggccggacgtgcggccggtccacggcgtgcacgcgcggatggccgaaaaaatgacgttgtcccacaaggagattccgaccgcaaaggccagcgttgaggtaatttgcgccgaactgctgcggctgcgcgaccggttcgtttcggcggcgcccgagattacaccgttcgcgctgacgctgcggctgctggttattgcattgaaacacaacgtaattctcaactcgacgtgggtcgactcgggcgaaggcccgcaagtacacgtgcatcgcggtgtgcatctggggttcggcgcggccactgagcgtggattgctggtgccggtggtgaccgacgcccaggacaagaacacccgcgaacttgcctcccgcgtagcggaattaatcaccggcgcacgtgaaggcactctcacacccgcggagctgcgcggttcgacgttcacggtgtcgaacttcggggcgctgggagtcgacgacggcgtgccggtgatcaaccatcccgaagcggcgatcctgggtctgggggcgatcaagccgcgcccggtggtcgtcggcggcgaggttgtcgcacggccgacgatgacgttgacttgtgtgttcgaccaccgcgttgtcgatggtgctcaggtggcccagttcatgtgtgagctgcgggatctgatcgagtcgccggagaccgcgctgttggatctgtag

SEQ ID NO: 359 - DNA, 9210 bp, Mycobacterium Tuberculosis
gtgacgatccacgagcacgaccgggtgtccgctgatcgcggcggggacagcccgcataccacccacgctctggtcgatcgcctcatggctggtgagccctacgctgtcgcattcggtggccagggcagcgcctggctggaaaccctcgaagagctggtgtcggccaccgggatagaaaccgagttggcgacgttggtcggtgaggcagagctgttgctcgatccggtcaccgacgagctgattgtggtgcgcccgatcggtttcgagccgctgcaatgggtacgcgcactggcggccgaggacccggttccgtccgacaagcacctgacgtcggccgccgtgtcggtgcccggcgtgttgcttacccagatcgcggcgacccgggcgctggcccgtcaaggcatggacctcgtggccaccccgccggtcgccatggcggggcattcgcaaggtgtgctggcggtggaagccctcaaggctggtggggcacgcgacgtcgagctgtttgccttggcccagttgatcggtgccgccggaacgctggtggcccgccggcgcggaatttccgtcctgggcgatcgcccgccgatggtatcggtcaccaacgccgaccccgagcgcatcggccggttgctcgacgagttcgcccaggacgtgcgcacggtgctgccaccggtgttgtccatccgcaacggccggcgtgccgtcgtcatcaccggcacccccgagcagctgtcgcgtttcgagctttattgccgccagatctccgagaaggaagaagccgaccgcaagaacaaggtccgcggcggcgacgtcttctcgccggtcttcgagccggtgcaggtggaggtgggctttcacaccccgcggctatccgacgggatcgacatcgtcgcgggctgggccgagaaggcgggcctcgatgtcgccttggctcgggagctggccgatgccatcttgatcagaaaggtcgactgggtcgacgagatcacccgtgtccacgcggccggcgcccgctggatcctcgacctggggccgggcgacatcctgacccgactgaccgcaccggtgatccgcggcctgggcatcggcatcgtgccggcggctacccgcggtggccagcgcaacctgttcaccgtcggcgccacccccgaggttgcccgggcctggtcgagctacgcaccgaccgtggttcgcctccccgacggcagggtcaagctctcgacgaagttcacccggctgaccggccgctcgccgatcctgctcgcgggcatgaccccgaccaccgtggacgccaagatcgtcgccgcggcggccaacgccgggcactgggccgagctggccggcggcgggcaggtcaccgaagagatcttcggtaaccgcatcgaacaaatggccggcctgctcgagccgggccgcacctatcagttcaacgcgctgttcctcgatccctacctgtggaagcttcaggtgggcggcaagcggttggtgcagaaggcccgccagtccggcgccgcgatcgacggcgtggtgatcagcgccggcatcccagacctcgacgaggccgtcgagctgatcgacgaactgggcgacatcggcatcagccacgtcgtgttcaaacccgggaccatcgagcagatccgctcggtgattcgcatcgccaccgaggtgcccaccaagccggtgatcatgcacgtcgagggcgggcgcgccggcgggcaccattcctgggaggatctcgacgacctgctgctggctacctactcggagttgcgctcacgcgccaacatcacggtgtgcgtcggcggcggcattggcaccccgagaagggctgcggaatatttgtccgggcgctgggcgcaggcctacggcttcccattgatgccgatcgacggcatcctggtcggcaccgcggcgatggccaccaaggaatccaccacgtcgccatcggtcaagcggatgctcgtcgacactcagggcaccgaccaatggatcagcgccggaaaagcgcagggcggcatggcctccagccgcagtcagctcggtgccgatatccacgagatcgacaacagcgcatcccggtgcgggcggctgctcgacgaggtggccggtgacgcggaggcggtcgcggagcgtcgcgacgagatcatcgcggcgatggccaagaccgccaagccctacttcggcgacgtcgccgacatgacctacctgcagtggctgcggcgctacgtcgaactggccatcggggaaggcaactcgaccgccgacaccgcctcggtgggcagcccgtggctggccgacacctggcgggaccgcttcgagcagatgctgcagcgtgccgaagcccggttgcacccacaggatttcggcccgatccagacgctattcaccgatgctggcctgctggacaatccgcagcaggcgatcgccgccctgctggcgcgctaccccgacgccgagaccgtgcagttgcatcccgcggatgtgccctttttcgtgacgttgtgcaagacgctgggcaagccggtcaacttcgtgccggtgatcgaccaggacgtgcggcgctggtggcgcagcgactcgctgtggcaggcccacgacgcccgctacgacgccgatgcggtgtgcatcattccgggcaccgcgtcggtagccggcatcacccggatggatgaacccgtcggtgagttgctggaccgtttcgagcaagccgcaatcgatgaagtgctcggcgccggtgtcgagccgaaggatgtcgcgtcgcgccggctgggccgcgccgacgtggccggaccgttggctgtcgtcctcgacgcacccgatgtgcgctgggccggtcgcaccgtgaccaacccggtgcatcggatcgccgacccggccgaatggcaggtgcacgatggacccgaaaacccgcgcgccacacactcatccaccggcgcccggctgcagacgcacggcgacgacgtcgccttgagcgtgcccgtctcgggcacctgggtcgacatccgattcacgttgccggccaacaccgtcgatggcggcaccccggtgatcgccaccgaggacgccaccagcgccatgcgcacggtgctggcgatcgccgccggtgtcgacagcccggagttcttgcctgcggtggccaacgggacggccactttgacggtggactggcaccccgagcgtgttgccgaccacaccggcgtcaccgccacgttcggtgagccgctggcacccagcctcaccaacgtgcccgacgcgctcgtcggcccttgttggccagcggttttcgcggccatcggatcggcggtcaccgacaccggtgagccggtggtggaaggcctgctgagcctggtgcatctggaccacgccgcccgcgtggtcggtcagctgcccacggtcccggcccaattgaccgtcaccgcaacggctgccaacgcaaccgatacggacatgggccgcgtcgtgccggtctcggtcgtcgttaccggcgccgatggcgccgtgatcgccactctcgaggagcgattcgcgatcctgggtcgcaccggttccgccgagctcgccgacccggcgcgagccggtggcgcggtgtcggcgaacgccaccgacaccccgcgccgtcgccgccgcgacgtcacgatcaccgcgccggtcgacatgcgcccgttcgcggtggtgtccggcgaccacaaccccattcacaccgaccgggccgccgcgctgcttgccggcctggagtcgccgatcgtgcacggcatgtggctgtcggccgcggcgcaacacgcggtgaccgccaccgacgggcaggcccggccaccggcccggctggtcggctggaccgcgcggtttttgggcatggtgcgccccggcgacgaggtggacttccgcgtcgagcgcgtcggaatcgaccagggcgcagagattgtggacgtggccgcgcgcgtcgggtcggatctagtgatgtcggcctccgcgcgactggccgcacccaagacggtctacgcattccccggccagggcatccaacacaagggcatgggcatggaggtgcgcgcccgctccaaggcggcccgcaaggtgtgggacaccgcggacaagttcacccgcgacaccctgggcttctcggtactgcacgtggtccgcgacaacccgaccagcatcatcgccagcggtgtgcactaccaccaccccgacggggtgctctacctgacgcagttcacccaggtcgcgatggcgacggtggcggccgcgcaggtcgccgagatgcgtgaacagggagccttcgtcgaaggcgccatcgcgtgcggccactcggtcggcgagtacaccgcgctggcctgcgtgaccggcatctaccaactggaagccttgctggagatggtgtttcaccgcgggtcgaagatgcacgacatcgttccgcgcgacgagctcggccgctccaactatcggctggcggccatccggccgtcccagatcgacctcgacgacgccgacgtgcccgcgttcgtcgccgggatcgcggagagcaccggtgaattcctggagatcgtgaatttcaacctgcgtggctcgcaatacgcgatcgcgggcacggtacgcggcctcgaggcgctcgaggccgaggtggagcggcgccgcgagctcaccggcggccgacggtcgttcattttggtgcccggcatcgatgttccgttccactcgcgagtgctgcgggtcggggtggccgaattccggcgctcgctggaccgggtcatgccgcgcgacgcggaccccgacctgatcatcgggcgctacattcccaacctggtgccgcggttgttcaccctggaccgcgacttcatccaggaaatccgggatttggtgcccgccgagccgctcgacgagatcctcgccgactacgacacctggcttcgcgagcgtccgcgcgagatggcgcgcacggtgttcatcgagctgctggcatggcaattcgccagcccggtgcgctggatcgagacgcaggatctgctgttcatcgaggaggccgccggcgggctgggtgtggagcgattcgtcgagatcggtgtgaagagctcaccgacggtggcgggtcttgccaccaacaccctcaaactgcccgaatacgcccacagcacagtggaagtgctcaacgccgagcgtgatgccgcggtgctgttcgccaccgacaccgacccggagccggagccggaggaagacgagccggtcgcggaatcgcccgcgccggacgtcgtctcggaagccgcccccgtcgcgccggccgcttcgtcggcgggcccgcgtcccgacgatctggttttcgacgccgccgatgccacgctggcgctgatcgcgctctcggccaagatgcgcatcgaccagatcgaagaactcgactccatcgagtccatcaccgacggtgcgtcgtcgcggcgcaaccagctgctggtggacctgggctccgagctgaacctcggtgccattgacggcgccgccgaatcggacctggccggtctgcgctcacaggtgaccaaactggcgcgcacctacaagccttacggcccagtgctttccgacgccatcaacgaccagcttcgcaccgtcctcggaccgtcgggcaagcggcccggcgccatcgccgagcgggtgaagaagacctgggagctcggtgagggctgggccaagcatgtcaccgtcgaggtcgcgctgggcacccgcgagggcagcagcgttcgcggcggcgccatgggccacctgcacgagggcgcgctggccgatgccgcctccgtcgacaaggtcatcgacgcggcggtcgcatcggtggccgcgcgccagggcgtttcggtagcgctgccgtcggccggtagtggtggcggcgccaccatcgacgcggccgcgctcagcgagttcaccgaccaaatcaccggccgtgagggcgtgctggcctccgcggcccgcctggtgctggggcagctgggactggacgaccccgtcaacgccttgccggccgcccccgattccgagctgatcgacttggtcaccgccgaactgggagcggactggccgcggttggtggcaccggtgttcgaccccaagaaggccgtcgtattcgacgaccgctgggccagcgcccgcgaggacctggtgaagctgtggctgaccgacgagggcgacatcgacgccgactggccgcgcctggcggagcgcttcgagggtgccggccacgtcgtggcgacccaggctacctggtggcaaggtaagtcgctggccgcgggccggcagatccatgcatcgctgtacggccgcatcgccgccggcgccgagaaccccgaacccggccgctacggcggcgaagttgccgtggtgaccggcgcttcgaagggttcgatcgccgcgtcggtggtggctcggctgctcgacggcggagccaccgtcatcgcgaccacctccaagctcgacgaggagcggctggcgttctaccgcacgctgtatcgcgaccacgcccgttacggcgcggcgctgtggctggtcgcggcgaacatggcgtcctactccgacgtcgacgccctggtcgaatggatcggcaccgaacagaccgaaagccttgggccgcagtcgattcacatcaaagacgcgcagaccccgacgctgctgttcccgttcgcggcgccacgcgtggtcggggacctgtcggaggccggttcgcgcgccgagatggagatgaaagtgctgctgtgggccgtgcaacggctgatcggcggcctgtcgacgatcggcgccgaacgcgacatcgcgtcgcggctgcacgtggtgctgcccggctcgcccaaccgtggcatgttcggcggcgacggcgcctacggcgaagccaagtccgcgctggatgccgtggtgagccgctggcacgccgagtcgtcctgggcggcacgggtcagcctggcgcacgcgctcatcggctggacccgcggcaccgggctgatgggccacaacgatgccatcgtggccgccgtcgaagaggccggggtcaccacctactcgaccgacgagatggcggcgctgctgctcgacctgtgtgatgcggaatccaaggtggctgcggcgcgttcgccgatcaaggccgacctgaccgggggcctggccgaggccaacctcgacatggccgagctggcggccaaggcgcgcgagcagatgtcggcagcggcggccgtcgacgaggacgccgaggcccctggcgccatcgccgcgctgccgtcgccgccccggggtttcacccccgcaccgccgccgcaatgggacgacctcgatgtcgacccggccgacctggtggtgatcgtcggcggcgccgaaatcggcccgtacggctcgtcacgcacccggttcgagatggaggtcgaaaacgagctgtcggcggccggcgtgctggagctggcctggaccactgggttgatccgctgggaggacgacccgcaacccggttggtacgacaccgaatccggcgaaatggtcgacgaatccgagttggtgcagcgctaccacgacgccgtggtgcagcgcgtcggcattcgcgaattcgttgatgacggcgcgatcgaccccgaccacgcctcgccgctgctggtgtcggtgttcctggagaaggacttcgcgttcgtggtgtcctcggaggccgatgcgcgcgccttcgtcgagttcgatcccgagcacacggtcatccggccggtgcccgactccaccgactggcaggtcatccgcaaggccggcaccgagatccgggtgccgcgaaagaccaagctgtcccgcgtcgtcggcggccagatcccgaccgggttcgacccgacggtgtggggcatcagcgcagacatggccggttccatcgaccggttggcggtatggaacatggtggcgaccgtcgacgcgttcctgtcgtccggtttcagcccggccgaggtgatgcgttacgtgcacccgagtttggtggccaacacccagggcaccggcatgggcggcggcacgtcgatgcagacgatgtaccacggcaatctgttgggccgcaacaagccgaacgacatcttccaggaagtcttgccgaatatcattgccgcgcacgtggttcagtcctacgtcggtagctacggtgcgatgatccacccggtagccgcgtgcgccaccgccgcggtgtcggtcgaggaaggtgtcgacaagatccggttgggcaaggctcaactggtggtggccggcggcctggatgacctgacgctggagggcatcatcggattcggtgacatggccgccaccgccgacacgtccatgatgtgcggccgcggcatccacgactcgaagttttcccggcccaacgaccgccgccgtctgggcttcgtcgaagcccaaggcggcgggacgatcctgttggcccgcggggacctggcgctgcggatggggctgccggtgctggcggtggtggcgttcgcgcagtcgttcggcgacggcgtgcacacctcgatcccggccccgggcctgggcgcgctgggggcgggccgcggcggcaaggattcaccgctggcgcgggcgctggccaagctgggcgtggccgccgacgacgtggcggtcatctccaagcacgacacctcgacgctggccaacgatcccaacgagaccgagttgcatgaacggctcgccgacgccctgggccgttccgagggcgccccgctgttcgtggtgtcgcagaagagcctgaccggccacgccaagggcggcgcggcggtcttccagatgatggggctctgccagatattgcgggatggggtgatcccacccaaccgcagcctcgactgcgtcgacgacgagctggccggctccgcgcatttcgtgtgggtgcgtgacacgttgcggctcggcggcaagttcccactcaaggccggcatgctgaccagcctcgggttcggccatgtgtcgggcctggtcgcgttggtgcatccgcaggcgttcatcgcctcgctggatcccgcacagcgcgcggactaccagcggcgtgccgacgcccgcctgctggccggtcagcgccggctggcctcggcgattgccggtggtgcgccgatgtaccagcggcccggtgaccgtcgcttcgaccaccacgcgcccgagcggccgcaggaggcgtcgatgctgctgaatccggcggcccggctgggtgacggcgaggcgtatatcggctga

SEQ ID NO: 360 - DNA, 402 bp, Mycobacterium Tuberculosis
atgaccacctggattctggacaagagtgcccacgtgcgactcgtggccggcgccacgccgccagccggcatcgacctcaccgacctcgccatctgcgatatcggcgaacttgaatggctgtattcagcacggtcagctaccgactacgacagccaacaaacgtcactgcgcgcctatcaaatccttcgcgcacccagcgacatctttgaccgggttcgccaccttcagcgcgacctagcccaccaccgtgggatgtggcatcgaacgccgcttccggacctattcatcgccgaaaccgcgcttcatcaccgggccggcgtgttgcaccacgaccgtgactacaaacgaattgccgtcgtacggcctgggtttcaagcatgcgaactctctcgcgggcgctag

SEQ ID NO: 361 - DNA, 693 bp, Mycobacterium Tuberculosis
atgactaactggatgctgcgcgggttggcgttcgccgccgcgatggtggttctccgcctgttccagggggcattgatcaacgcgtggcagatgctgtccgggctgatcagcctggtgctactgctgctcttcgcgatcggaggggtggtgtggggtgtgatggacgggcgcgccgacgccaaggcgagccctgaccccgaccgccgccaagacctggccatgacctggctgttggccggcctggtagccggcgcgctcagcggcgcggtggcctggctcatttcgctgttctacaaagcgatctacaccgggggcccaatcaacgagctgaccacgttcgcggccttcaccgcgctcatcgtctttctggtcgggatcgtcggggtagccgtgggccggtggctggtggaccggcagctggcgaaggcaccggtgcgacaccacgggcttgccgctgaacacgagcgggccgccgacaccgatgtattctccgccgttcgcgccgacgacagtccgaccggggagatgcaggtcgcgcagcctgaggcacaaaccgcggccgtcgccacggtcgaacgtgaggcacccaccgaggtgatccgcaccaccgaaagcgatacacccaccgaggttatccgcaccgacaccgaggcggaccagaccaagcccggcgacgagcccaagaaggattaa

SEQ ID NO: 362 - DNA, 1089 bp, Mycobacterium Tuberculosis
atgaccgatatcggcgcacccgtgaccgtgcaggtggccgtcgatccgccatacccggtggtcatcggtaccggcctgctcgacgagctggaagacctgctggccgaccggcacaaggtcgccgtcgtgcatcagcccggactagccgagaccgcggaagagatccgaaagcgcttggccggcaagggcgtcgacgcgcaccgcatcgagatccccgacgccgaggccggcaaggacctgcccgtcgtgggattcatctgggaggtgttgggccgcatcggaatcggccgcaaagacgccctggtcagcctcggcggcggggccgccaccgacgtcgccgggttcgcggcggccacctggctgcgcggcgtctcgattgtgcacctgcccaccacactgctgggcatggtcgatgcggccgtcggcggcaagaccggcatcaacaccgacgccggcaagaacctggtcggggcgtttcatcagccgttggcggtcctggtggacctggcgacgctgcaaaccttgccacgcgacgaaatgatctgcggcatggccgaagtggtcaaggccggcttcatcgccgacccggtgatcctggatctcatcgaagctgacccgcaggccgcactcgacccggccggcgacgtgctgcccgagctgatccggcgcgcgatcaccgtcaaggccgaggtggtcgccgccgacgaaaaggaatccgagctgcgcgaaatcctcaactacggccacacattaggccacgcgatcgagcgccgggaacgctaccggtggcgccacggcgccgccgtgtcggtggggctggtgttcgcggccgagctggccaggcttgccgggcggctcgacgacgcgaccgcgcagcgccaccgcaccatcctgtcctcgttgggattgccggtcagctacgacccggacgcgctgccccagctgctggaaatcatggccggcgacaagaagactcgggcgggtgtgttgcggttcgtggtgctcgacggattggccaagccgggccgaatggtgggaccggaccccggtctgctggtaaccgcctacgccggagtttgcgccccatga

SEQ ID NO: 363 - DNA, 663 bp, Mycobacterium Tuberculosis
ttgatcgcaccacaaccgattccccgaacgctcccacggtggcagcgcatcgtcgcgctgaccatgatcggcatatcaaccgccctgataggtggctgcacaatgggccaaaaccccgacaaatcaccgcacctgaccggcgagcagaagatccagctcatcgacagcatgcgccacaaaggctcctacgaggccgcccgggaacgcctcaccgccaccgcccagatcatcgccgaccgcgtcagtgcggccatcccgggccaaacctggaaattcaacgacgactcctacggccaagacttctatagaaatggatcgttgtgtaaggaactcagtgccgatatcgcccggcggccgatggccaaaccggttgacttcggtagcacattctcggcggaagacttcaagattgccgccaatatcgtgcgagaggaagccgccaagtacggtgtgaccaccgagtcgtcgctgtttaacgaatcggccaaacgcgactacgacgtgcagggcaacggctacgaattcaacctgggccaaatcaaattcgccacacttaacatcaccggcgactgttttctgttgcagaaggtgctcgacctgccggccggacaactcccccccgaaccacccatttggccgacgacctcgacgccaaccccgtga

SEQ ID NO: 364 - DNA, 1050 bp, Mycobacterium Tuberculosis
atgctttttgcggctttgcgtgatgtccaatggcgaaaacgacgccttgtcatcgcaatcgtcagcaccggcctagttttcgcgatgacgctcgttctgaccggacttgtgaacgggtttcgggtcgaggccgagcgaaccgtcgattccatgggtgtcgacgcattcgtggtcaaggccggcgcggcaggaccgttcctgggttcgacaccattcgcccaaatcgacctgccccaggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatctgcaagtgggtgcgcgcactttgcggatcgtcggcatcgtgcccgagtcaaccgcgctggcaaagattcccaacatcttcctgaccaccgaaggcctacagcagttggcatacaacggacagccgacaatcagttcgatcgggatcgacgggatgccccgacagctcccggacggctatcagaccgtcaatcgagcggatgctgtcagcgatctgatgcgcccgttgaaggtcgcggtggatgcgatcacggttgtggcggtcttgctgtggatcgttgcggcgttgatcgtcggctcggtggtctacctctctgcgttggagcggctgcgtgactttgcggtgttcaaggcgatcggcgtgccgacgcgctcgattctggccgggctggcgctgcaggcggtcgtcgtcgcgctgctcgcggcggtggttggcggcatcctttcgctgctgttggcgccgttgttcccgatgactgtcgtggtacccctgagtgccttcgtggcgctaccggcgatcgcgactgtgatcggtctgctggccagcgtcgcaggactgcggcgcgtggtggcgatcgatccggcactagcgttcggaggtccctag

SEQ ID NO: 365 - DNA, 1068 bp, Mycobacterium Tuberculosis
atgagcgcttcgctgctagtcaggacggcctgcggcggccgtgcggtcgcccaacggttgcgcaccgtgctgtggccgatcacccagacatcggtcgtcgccggcctcgcgtggtatctcacccatgacgtgttcaaccatccgcaggcgttcttcgcgccgatttcggctgtggtgtgcatgtcggcgaccaacgtgctgcgcgcacgacgtgcccaacagatgatcgtcggggtggcgctggggatcgtgctgggtgctggcgtgcatgctctgcttggttccggaccgatcgccatgggtgtggtggtgttcatcgcgttgtcggtcgcggtgctgtgcgcacgcgggttggtcgcgcaaggcttaatgttcatcaaccaggccgccgtctccgcggtgctggtcttggtcttcgcgtccaacggcagtgtggttttcgaacgcctcttcgacgcgctggtcggtggtgggctggctatcgtgttcagcattctgctcttcccgcccgacccggtggtcatgctgtgcagtgcgcgcgccgacgtgttggccgctgtgcgcgacatcctcgccgagctggtgaacacggtgagcgatcccaccagcgccccgcccgactggccgatggcagccgctgatcgactgcatcagcagctgaacgggctcatcgaggtgcgcgccaacgctgccatggtggcgcggcgagcgccccgccgatggggggtgcgcagcactgtccgcgatctcgatcaacaggccgtctacctggccctgctggtcagttcggtgttgcatctggctcgcaccattgccgggcctggtggcgataagctgccaacgcccgtgcacgccgtgctcaccgacctcgccgcgggaaccggcctggccgacgcggatccgacggcagcgaacgagcacgcggccgccgcccgcgcaaccgcgtcgacactgcaatcggctgcttgtggcagcaacgaagtggtgcgcgccgatatcgtccaagcgtgtgtcaccgatctacaacgggtaatcgaacgcccgggcccgtcgggcatgtcagcctga

SEQ ID NO: 366 - DNA, 903 bp, Mycobacterium Tuberculosis
atgacagcattcggcgtcgagccctacgggcagccgaagtacctagaaatcgccgggaagcgcatggcgtatatcgacgaaggcaagggtgacgccatcgtctttcagcacggcaaccccacgtcgtcttacttgtggcgcaacatcatgccgcacttggaagggctgggccggctggtggcctgcgatctgatcgggatgggcgcgtcggacaagctcagcccatcgggacccgaccgctatagctatggcgagcaacgagactttttgttcgcgctctgggatgcgctcgacctcggcgaccacgtggtactggtgctgcacgactggggctcggcgctcggcttcgactgggctaaccagcatcgcgaccgagtgcaggggatcgcgttcatggaagcgatcgtcaccccgatgacgtgggcggactggccgccggccgtgcggggtgtgttccagggtttccgatcgcctcaaggcgagccaatggcgttggagcacaacatctttgtcgaacgggtgctgcccggggcgatcctgcgacagctcagcgacgaggaaatgaaccactatcggcggccattcgtgaacggcggcgaggaccgtcgccccacgttgtcgtggccacgaaaccttccaatcgacggtgagcccgccgaggtcgtcgcgttggtcaacgagtaccggagctggctcgaggaaaccgacatgccgaaactgttcatcaacgccgagcccggcgcgatcatcaccggccgcatccgtgactatgtcaggagctggcccaaccagaccgaaatcacagtgcccggcgtgcatttcgttcaggaggacagcccagaggaaatcggtgcggccatagcacagttcgtccggcggctccggtcggcggccggcgtctga

SEQ ID NO: 367 - DNA, 348 bp, Mycobacterium Tuberculosis
atggagagtttcgttttgttcttgccgttcctgctcatcatgggtgggttcatgtacttcgcgtcgcgccgccagcgacgggccatgcaagccaccatcgatctgcacgactcgttgcagcccggggagcgggtacacacgacttctgggctggaagccaccatcgtcgccattgccgacgacaccatcgacctcgagatcgcgcccggggtggtcaccacgtggatgaagttggcgattcgtgaccgaattctgccggacgacgacatcgacgaggagctcaacgaggaccttgacaaggatgttgacgacgtggccggcgagcgccgggtgaccaacgattcctga

SEQ ID NO: 368 - DNA, 3507 bp, Mycobacterium Tuberculosis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 369 - DNA, 1035 bp, Mycobacterium Tuberculosis
atgaccgagcggtccgaccgcgacgtttcgcccgcactcaccgtcggagagggcgacatcgacgtcagcctgcggccgcgctcgttacgcgaattcatcggccagccccgggtccgcgaacagctgcagctggtcatcgagggagccaaaaaccgcggcggcacaccggatcacattctgctgtccggtccgccgggcttgggcaagacgtcgttggcgatgatcatcgccgccgagctggggtcctcgctgcgggtgacgtcggggccggcgttggaacgcgccggtgacctggcggcgatgctgtccaacctggtcgagcacgacgtgttgtttatcgacgagatccaccgcatcgcccggcccgccgaggagatgctgtatctggcgatggaagacttccgcgtcgatgtggtggtcggcaaaggtcctggggccacgtcgattccgctggaggtcgcgccgttcaccctggtcggggcgactacccggtcgggcgcgttgaccggcccgctgcgcgaccggttcggcttcaccgcgcacatggatttctacgagcccgccgagctggagcgggtgctggcccgctccgccggaattctgggtatcgagctgggcgccgacgccggcgccgaaatcgcccgccgttctcggggaacgccgcggatcgccaaccggttgttgcgccgggtgcgtgacttcgccgaggtgcgcgccgacggcgtcatcacccgcgacgtcgccaaggccgcactggaggtctacgacgtcgacgagctgggtctggaccggctggaccgagcggtgctctcggcgctgacccgcagcttcggcggtggtccagtgggtgtgtcgacgctggcggtggcggtcggggaggaggccgccacggtcgaggaggtgtgcgaaccatttctggtgcgcgcgggtatggtcgcgcgcaccccgcgcggccgggtggccaccgccctggcctggacgcacctgggcatgacgccaccggtcggagcgagtcaaccggggttgttcgagtag

SEQ ID NO: 370 - DNA, 495 bp, Mycobacterium Tuberculosis
gtgccacttcatcagctcgccatagcgccggtggacgtatcaggggcattgcttggactcgtgctgaacgcacccgcgccgcggccactggccacccaccgactggcccacaccgacggcagcgcactgcagctcggcgtcctcggcgcgtcgcatgtcgtcaccgtcgagggacgcttctgcgaggaagtctcctgcgtggcccgcagccggggcggcgatctgcccgagtccacccacgcacccggctaccacctccaatcccataccgagacgcacgacgaggcggcgtttcggcgactcgcgcgccacctgcgtgaacgctgcacgcgggcaaccgggtggctgggcggtgtgtttcccggtgatgacgccgcgctgaccgcactcgccgccgaacccgatggaaccgggtggcgttggcggacttggcatctgtacccgagcgcgtccggcgggacggtggtccacacgacgagccgatggcgtccatga

SEQ ID NO: 371 - DNA, 756 bp, Mycobacterium Tuberculosis
atgagcggccattccaagtgggccaccaccaagcacaagaaggccgtcgtcgacgcccgccgcggcaagatgttcgcccggctgatcaagaacatcgaggtggcggcgcgtgtcggtggcggtgatccggccggcaaccccacgctctacgacgcgattcagaaggcgaagaagagctcggttcccaacgagaacatcgaacgggcccgcaagcgcggcgccggcgaggaggccggcggcgccgactggcagaccatcatgtacgagggctacgcgcccaacggggtggcggtgctgatcgagtgtctgaccgacaaccgcaatcgcgccgccagcgaggtgcgggtggcgatgacgcgcaatggtggcaccatggccgatccggggtcggtgtcctacctgttctcccgcaaaggcgtggtgaccctggaaaagaacggcttgaccgaagacgatgtgctggcggctgttctggaagccggtgccgaggacgtcaacgacctgggcgacagtttcgaggtcatctccgagcccgcggaactggtcgcggttcgtagcgctttgcaagatgccggcatcgattacgaatcggccgaggccagctttcaaccctcggtcagcgtgcccgtggacctggacggcgcacggaaagtgttcaagctcgtcgacgcgctagaagacagtgacgacgtgcagaacgtgtggaccaacgtcgacgtgtccgacgaggtgctggccgccctcgacgacgagtga

SEQ ID NO: 372 - DNA, 900 bp, Mycobacterium Tuberculosis
atggatcctgcaggtaacccagcgaccggtacggcgcgggtcaagcgcggcatggccgagatgctcaagggcggcgtcatcatggacgttgtcaccccggagcaggcccgcatcgccgagggcgccggtgcggttgcggtaatggcgttggaaagggtgcccgccgatatccgcgcccagggcggggtgtcgcggatgagtgaccccgacatgatcgagggcatcatcgccgcggtcaccatcccggtgatggctaaagtgcgcatcggccactttgtcgaggcgcagatcctgcagacgttgggcgtcgactacatcgacgagtccgaggtgctgacgcccgctgactacgcccaccatatcgacaagtggaacttcacggtgcctttcgtgtgtggggcgaccaatctcggtgaggcgttgaggcgcatcagcgagggagcggccatgatccggtccaagggcgaggccgggaccggagacgtctccaacgcgaccacacacatgcgggccatcggtggtgagatccgccggttgacgtcgatgtcggaggacgaattgtttgtcgcggcaaaagaattgcaagcgccctatgaactcgttgccgaggtagctcgggcgggcaagttgccggtcacactgttcaccgccgggggtatcgccacgcccgccgacgcggcgatgatgatgcagcttggcgccgagggcgtcttcgtgggttccggtattttcaagtccggcgcccctgagcaccgcgccgccgcgatcgtcaaggccaccacgttcttcgacgatcccgatgtgctggccaaggtgtcgcgcgggctgggcgaggcgatggtgggcatcaacgtggacgagatcgctgtcggtcatcggctcgcccagcgcggctggtga

SEQ ID NO: 373 - DNA, 228 bp, Mycobacterium Tuberculosis
gtgggcgatcggtaccgggcaggtgaccgggtgctttacggcggctcgatgagcccaaaggatgttgacgacctggctacccagcaggacgtcgacgacggacagtcgatagagcgtcgctggacggggagcggtcagcgacgctggcggcggtcgccgccgacgggccgctaccgtagcaactcgcaaatccaggtctggatttccggcgccggccggctccgttag

SEQ ID NO: 374 - DNA, 1386 bp, Mycobacterium Tuberculosis
atgtcgtttgtcaacgtggccccacagttagtgtccacagccgcggccgatgcagcgcggatcggctcggcgatcaacaccgccaacaccgcggcggcggcgaccacccaggtgttggccgccgcccaagacgaggtgtcaacggcgatcgccgcgctgttcggcagccacggccagcactatcaagcgatcagcgcgcaggtcgcggcctatcagcaacggttcgtgctggccttaagccaagctggcagcacctacgcggtcgccgaagcggccagcgcaacaccgctgcagaacgtgctcgatgcgatcaacgcacccgttcagtcgctgaccgggcgcccattgatcggcgacggcgcgaacgggatcgacgggaccgggcaagccggcggtaacggcgggtggctgtggggcaacggcggcaacggcgggtcgggggcacccgggcaggccggcggggccggcggtgcggccgggttgatcggcaacggtggggccggcggagctggcggccagggcctaccctttgaggccggcgcgaacggcggagccggcggcgccggtggatggctgttcggcaacggcggggccggcgggaacggcgggatcggtggggccggcaccaacctcgctatcggcgggcatggtgggaacggcggcaacgccgggctgatcggcgccggcgggaccggcggggccgggggcaccggcggcggcgagccctccgcgggggctagcggcggcaacggcgggaacggcgggaacggcggcctactgatcggcaacagcggggacggcggggccgccggaaacggggcaggcatttctcagaacggtccagcgtccggattcgggggtaacggtggtcacgccggaaccaccggactgatcggcaacggcggcaatggcggagccggcggagccggtggtgatgtgtccgccgatttcgggggcgttgggtttggcgggcaaggcggtaacggcggcgccggcgggctactctacggtaacggcggggccggcggaaacggcggtgccgccgggtcgcccgggtctgttacggccttcggagggaatggcggtagcggcggcagcggtggaaacggcggcaatgccctcatcggcaacgcgggggccggtgggagcgccggggccggcgggaacggagcgagcgccggcactgctggcgggtccggcggtgacggcgggaaaggcgggaacggcggcagcgtcggactgatcggcaacggtggaaacggcggaaacggcggcgccgggagcctcttcaatggcgctccaggcttcggcgggcccggcggcagcggcggtgcatcactgttggggccacccggcctggccggcaccaacggagccgacggctaa

SEQ ID NO: 375 - DNA, 678 bp, Mycobacterium Tuberculosis
gtggatccggtgcgtcgccagctctaccaattcgtgtgctcacaatcgatgccggtgagccgagaccaggcggccgacgccgtcggcatcccgcgccaccaggcgaaattccatttggaccggctcactgccgaaggcctgctggataccgagtacgcgcgcctgaccggccggtccggccccggcgccgggcggaccgccaagctgtatcgccgggccggccgcgacatcgccctcagccttccacagcgggagtacgagcttgctgggcggctgatggccgcagccatcgtgctgtcggccaccaccggggagccgaccgtggaagtgctcaaccggatcgcccatgactacggccaagccatgggcgccgccgccaccacccggccgcccgcagaccccgcggcggcgctggagctgacgctggatgtgctgcgcaagtacggttatgaaccccgccgcccggctggccctggcgacgatgaggtcgagctggtgaactgcccgttccacgcactggcccgggagcagaccgagctggcctgcaatatgaaccacgccttgatcacaggcgtggccgacgcgctggcaccgcacagcccggccgttcggttggcacccggaccggcccggtgttgtgtagtactcaagcgatgttcggctcacgaccccgagtga

SEQ ID NO: 376 - DNA, 894 bp, Mycobacterium Tuberculosis
atgtcatcgggcaattcatctctgggaattatcgtcgggatcgacgattcaccggccgcacaggttgcggtgcggtgggcagctcgggatgcggagttgcgaaaaatccctctgacgctcgtgcacgcggtgtcgccggaagtagccacctggctggaggtgccactgccgccgggcgtgctgcgatggcagcaggatcacgggcgccacctgatcgacgacgcactcaaggtggttgaacaggcttcgctgcgcgctggtccccccacggtccacagtgaaatcgttccggcggcagccgttcccacattggtcgacatgtccaaagacgcagtgctgatggtcgtgggttgtctcggaagtgggcggtggccgggccggctgctcggttcggtcagttccggcctgctccgccacgcgcactgtccggtcgtgatcatccacgacgaagattcggtgatgccgcatccccagcaagcgccggtgctagttggcgttgacggctcgtcggcctccgagctggcgaccgcaatcgcattcgacgaagcgtcgcggcgaaacgtggacctggtggcgctgcacgcatggagcgacgtcgatgtgtcggagtggcccggaatcgattggccggcaactcagtcgatggccgagcaggtgctggccgagcggttggcgggttggcaggagcggtatcccaacgtagccataacccgcgtggtggtgcgcgatcagccggcccgccagctcgtccaacgctccgaggaagcccagctggtcgtggtcggcagccggggccgcggcggctacgccggaatgctggtggggtcggtaggcgaaaccgttgctcagctggcgcggacgccggtcatcgtggcacgcgagtcgctgacttag

SEQ ID NO: 377 - DNA, 1299 bp, Mycobacterium Tuberculosis
atgcaagtggtcaacgtggctacgctgccggggattgtccgggcctcgtatgcgatgcccgatgtgcactggggatatggtttcccaatcggcggcgtggccgcaaccgacgtcgacaatgatggagtcgtttccccaggcggtgtcggcttcgatatttcgtgcggcgtaagactcttggtcggcgaagggctggaccgcgaggagctgcaaccacggttgccggcggtcatggaccggcttgatcgcgcgataccgcgcggagtgggcacggcgggtgtgtggcgactacccgaccggaacacgctgcaggaggtgctcaccggtggtgcccggtttgcggtggaacaggggcatggcgtcgcgctagacctcgagcggtgcgaagacggcggtgtgatgacaggagcggacgcggccaaaatcagtgaccgggccctccaacgcgggcttgggcagatcggcagccttggctcgggcaaccacttcctggaagtccaggccgtggaccgcgtctacgatccggttgcggccgcgccgatgggtctggcggaagggaccgtctgcgtgatgatccacaccggctcacggggcctgggccatcagatctgcacggatcacgtccgccagatggaacaagccatgggccgatacggaatcgcggtgcccgatcgccaattggcttgtgtgccggtgcactcccccgatgggcaggcctatctcgccgcgatggcggcggcggccaactacggacgcgccaaccgccaactgctgaccgaggcgacgcgtcgtgtgttcgctgatgcaaccggaacacctctggacctgctctacgacgtgtcgcacaacctggccaagatcgagacgcatccgatcgacggtcagctgcgctcggtgtgcgtgcaccgcaagggcgccacccgctcgctgccgccgcaccatcacgagctgccggccgaactggcagcggtcggccaacccgtgctgatacccgggacgatgggtacggcgtcatatgtgcttgccggggtcaccggcaacccggcgttcttttccaccgcgcatggtgctgggcgggtactgagccgtcaccaggccgcccgccacaccagcggtgaagcgatacgcgccagcctcgcaaaacgtggcatcatcgtccgcggtacctctcgtaggggtatcgccgaggaaaagccggaggcctacaaagacgtcgacgaggtcatcgaagccagccatcagagtggcctcgcgcgcaaagtggctcgccttgttcccttgggctgtgtcaaaggatga

SEQ ID NO: 378 - DNA, 432 bp, Mycobacterium Tuberculosis
atgaccaccacgccccgacaacccctgttctgcgcccacgccgacaccaacggcgacccgggccgctgcgcctgcggccagcagctcgccgacgtcggcccggccaccccgccaccgccctggtgcgaaccgggcaccgaacccatctgggagcagctcaccgaacgatacggcggcgtcacaatctgccagtggacacgatattttccggccggcgacccggtggctgccgacgtgtggatcgccgccgacgatcgtgtcgttgacggccgggtgctgcgcacccaaccggcgattcactacacggaaccgcccgtgttggggatcggcccggcggcggcccgccggctggccgctgagctgctcaacgccgccgacaccctcgacgacggccgccggcagctagacgacctcggcgaacaccggcggtga

SEQ ID NO: 379 - DNA, 1128 bp, Mycobacterium Tuberculosis
gtgacgcaaaccggcaagcgtcagagacgcaaattcggtcgcatccgacagttcaactccggccgctggcaagccagctacaccggccccgacggccgcgtgtacatcgcccccaaaaccttcaacgccaagatcgacgccgaagcatggctcaccgaccgccgccgcgaaatcgaccgacaactatggtccccggcatcgggtcaggaagaccgccccggagccccattcggtgagtacgccgaaggatggctgaagcagcgtggaatcaaggaccgcacccgcgcccactatcgcaaactgctggacaaccacatcctggccaccttcgctgacaccgacctacgcgacatcaccccggccgccgtgcgccgctggtacgccaccaccgccgtgggcacaccgaccatgcgggcacactcctacagcttgctgcgcgcaatcatgcagaccgccttggccgacgacctgatcgactccaacccctgccgcatctcaggcgcgtccaccgcccgccgcgtccacaagatcaggcccgccaccctcgacgagctggaaaccatcaccaaagccatgcccgacccctaccaggcgttcgtgctgatggcggcatggctggccatgcgctacggcgagctgaccgaattacgccgcaaagacatcgacctgcacggcgaggttgcgcgggtgcggcgggctgtcgttcgggtgggcgaaggcttcaaggtgacgacaccgaaaagcgatgcgggagtgcgcgacataagtatcccgccacatctgatacccgccatcgaagaccaccttcacaaacacgtcaaccccggccgggagtccctgctgttcccatcggtcaacgaccccaaccgtcacctagcaccctcggcgctgtaccgcatgttctacaaggcccgaaaagccgccggccgaccagacttacgggtgcacgaccttcgacactccggcgccgtgttggctgcatccaccggcgccacactggccgaactgatgcagcggctaggacacagcacagccggcgccgcactccgctaccagcacgccgccaagggccgggaccgcgaaatcgccgcactgttaagcaaactggccgagaaccaggagatgtga

SEQ ID NO: 380 - DNA, 1587 bp, Mycobacterium Tuberculosis
atggctactgtggtcggcatgagtcggcccatgacgtcaaccgcgatgttggtcgcgctgacctgctcggcgacagtgctggccgcatgcgtcccggcgttcggcgccgacccgcggttcgcgacctactcgggcgcaggaccgcaaggcgcagccaccacgacaccaccgccggctggcccaccaccgctcgccgcacccaagaacgacttgtcgtggcacgactgcacgtcacgggtgtactcgaatgctgggatcccagcagcgcccggcgtcaagctggaatgcgcaagctatgacaccgacctcgacccgctcgtcggcgggtccacagcggtaagcatcggcgtagtgcgcgcgcgctccaaccagaccccgagcgacgcaggacccctggtgttcaccaccggctccgacctaccctcgtcgacgcagttgccggtctggctggcacacgcgggcatcgatgtgctccgcagccaccccattgtcgccgtcgaccgccgcggcatgggcatgtcgagcccaatcgactgccgcgatcactttgaccgcgacgagatgcgtgatcaggcgcaattccaggctggcgacgatccggtggccaacctttccgacatctccaacaccgccaccaccgactgcaccgacgccatcgcgccaggcgagtccgcctacgacaacacccacgccgcctcggatatcgagcgcttacgcaaactctgggacgtccctgccctcgccttcgtcggcattggcaacggcacccaagtggcgctggcctacgcagcatcgcgtcccgacaacgtcgccagactgatcctcgactccccaatcgcgttgggggtctctgccgaagccgccgccgagcaacaggtccagggccaacaggcggcgctggacgcattcgctgcgcaatgtgtcgcggtgaactgcgcgctgggctcccatccgaaaggcgcggtcagcgcgctgctgtcggccgcccggtccggtgatgggcccggcggcgcgtcggtggcggctgtcgccaacgccgtcgccaccgcgttgggcttccccgacagtggccgggtcgatagcaccacgaaattggccgacgcgctggccgcggcccgctccggggacatgaacttgctgtccgccctgatcaaccgcgccgataccacccgggatacggacggtcagttcatcagctcgtgcagcgatgcggtcaaccgcccgacaccggaccgggtgcgcgagctggtggtggcttgggggaagctctacccgcagttcggcgccgtcgcggcgctcaacctggtgaaatgcgtgcactggcccagcagttcgccgccgcagccaccgaaagacctcaaggtcgacgtgctgttgctcggtgtgcaaaacgacccgatcgtgggcaacgaaggggtcgccgcgaccgccgccacggccatcaacgccaacgccgccagcaagcgggtgatgtggcaaggtattggccacggcgccagcatctactcgtcctgcgcggtgccgccactcgtcgcctacctggacactggcaagctgcctgacaccgacacctattgccccgcctga

SEQ ID NO: 381 - DNA, 1074 bp, Mycobacterium Tuberculosis
atgagtacccgtcgcgaccttccgcagtcgccgtatctggccgccgtcaccggccgcaagcccagccgggtgccggtgtggttcatgcggcaggccgggcgctcgttgcccgaataccgggcgctgcgcgagcggtacagcatgctggcggcctgtttcgaaccggacgtggcctgtgagattaccctgcagccgatacgccgctacgacgtcgacgcggccatcctgttctccgacatcgtggtgccgctacgggcggccggcgtggatttggacatcgtcgccgacgttgggccggtgatcgcggacccggtgcgcaccgccgccgatgtcgccgccatgaaaccacttgatccacaagcgattcaaccggtattggtggcggcttcgttgttggtcgctgagcttggcgacgtgccgctgatcggtttcgccggcgcgccgttcacgctggcctcctacctcgtggagggcggaccgagccgccatcacgcccacgtcaaggcgatgatgttggccgagccggcgagctggcacgcgctgatggccaagctgaccgacctcaccatcgcgtttctggtcggccaaatcgacgcgggggtggacgccatccaggtattcgactcctgggccggggcgctctcgccgatcgactaccgccagtacgtgttgccgcacagcgcccgggtgttcgctgcgctgggcgagcatggcgtgccgatgacgcacttcggggttgggaccgccgaattgctgggcgcgatgtcggaggccgtgacagccggggagcggccaggccgaggggccgtcgtcggcgtggactggcggaccccgctgaccgacgccgccgcccgggtggtgcccggcacggcgttacagggcaacctcgatccggcggtggtcctggcgggctggccggcggtggaacgtgccgcacgtgccgttgtcgacgacggacgccgcgccgtcgacgccggtgcggccggccatatcttcaacctcggccacggggtgctgccagaaagcgatcccgcggtgctggccgacctggtctcgctcgtacactcgctatga

SEQ ID NO: 382 - DNA, 249 bp, Mycobacterium Tuberculosis
atgtcaggtatgcagacccagacgattgaacgtaccgacgccgacgaacgcgtcgacgacgggaccggcagcgacacaccgaaatacttccactacgtcaagaaagacaagatcgctgagagcgcggtcatgggtagccacgtggtggcgttgtgtggcgaggtgtttcccgttacccgcgcgcccaagccgggctcgccggtctgtcccgattgcaagcggatttacgacaccctcaagaagggctga

SEQ ID NO: 383 - DNA, 693 bp, Mycobacterium Tuberculosis
atgaacgagttggttgataccaccgagatgtacctgcggaccatctacgacctcgaggaagagggcgtgacgccactgcgtgcccggatcgccgagcggctcgaccagagcgggccgacggtcagccagaccgtgtcccggatggagcgcgatgggctacttcgggtggctggcgatcgccacctggagctcaccgaaaagggccgcgcgctggccatcgccgtgatgcgcaagcaccgcctcgccgaacggctcctcgtcgatgtcatcgggttgccgtgggaagaagttcacgccgaggcatgccggtgggagcacgtgatgagcgaggacgtcgagcgacggctggtcaaggtgctcaacaacccgaccacgtccccgttcggcaacccgatcccgggcctggtggaacttggcgtgggcccggaaccgggcgccgacgacgccaacctggtccggttgaccgagttgccggccggctcgccggtcgcagtcgtcgtccgccagcttaccgagcacgttcagggcgacatcgacctgatcacgcggctaaaagacgccggcgtggtgcccaacgcacgagtaaccgtcgaaaccaccccaggcggcggcgtgaccatcgtcatcccgggccatgagaacgtcaccctgccacacgagatggcccacgcggtcaaggtcgagaaagtctga

SEQ ID NO: 384 - DNA, 654 bp, Mycobacterium Tuberculosis
gtgctgtccgcagattcggcgctgaccgagcggcaacgcactattctcgacgtcatccgcgcgtcggtcactagccgcggatatccgccgagcatccgggaaatcggcgacgccgttggtctgacgtcgacgtcttcggtggcgcaccagctgcgcaccctggagcgcaagggctacctacgccgtgacccgaaccgcccccgcgccgtcaatgtgcgcggtgccgacgacgccgccctaccgccggtgaccgaagtggccggctcggacgccttaccggaacccacctttgtccctgtcctgggacgtatcgcggccggcggcccgatccttgccgaggaagccgttgaagacgtcttcccgctgccgcgtgagctggttggcgagggcaccctgttcctgctcaaggtgatcggtgactcgatggtcgaagccgcgatctgcgacggtgactgggtggtggtgcgacagcagaacgtcgccgacaacggcgacatcgttgcggccatgatcgacggtgaggccaccgtcaagacgttcaaacgcgccggcggtcaggtgtggttgatgccgcacaacccggccttcgatcccatcccgggcaacgacgcgacggtgctgggcaaggtcgtcacggtgatccgcaaggtctga

SEQ ID NO: 385 - DNA, 696 bp, Mycobacterium Tuberculosis
gtgttgagcgccatcgggatcgttccgtccgcgccggtgttggttcccgaactggccggagccgccgctgccgagctggccgatttgggggccgcggtgatcgcggcggcctccttgttgccgaaaagctggattgctgtcggaaccgggcgcgccgacgacgtcgtgcgccccaccgacgtcggcacctttgcgggcttcggcgccgacgtgcgagtcgggctcgcgccgcaggacggtgacggagttgccgttccggtggaattacccctgtgtgcgctacttaccgcctgggtacggggccaggcccggcctgaggccagggcacaggtccacgtctatgccagcgaccacggttccgatgccgcggtggcacgtggcaggcaactgcgagccgacatcgaccgggagcccgatccgatcggggtactagtcgtcgccgacggcctgaacaccctgacgccccgcgctcccggcggctatgaccccgacggcgccggtatgcagcgggctctcgacgacgcgttggccagcggcgacctcgccgtcttgacccggctgcccgcacaggtgcttgggcgggtggcatttcaggtgctggccggcctggccgagccaggaccgcgatcggccaaggagttctaccgaggagcgccacacggcgtggggtatttcgccggtgtctggcagccgtga

SEQ ID NO: 386 - DNA, 906 bp, Mycobacterium Tuberculosis
atggccagcgtcgaattcgcgaccattctggcgctgggcgccgcgttgctggccgggatcgggtatgtgacacttcagcggtccgcgcgacaggtcaccgctgaagaatatgtcggccatttcacgttgttccacctctctttgcgtcacgctctgtggtggctgggcagcctggccgcagtcgccagtttcaccctgcaggccattgcgctgacgatgggttcggtggtgttggtgcagtcgctgcaggccaccgcactgttgttcgcgctgctgatcgatgctcggttgactcatcaccgctgtactcccagggagtggatgtgggcggtattgctggccggcgcggtggccgtcatcgtcatgtcgggcaacccggcggccggcactactcgggcccccttctcgacctgggcggtggttgctgtcgtggttgttccggcggtggtgctttgtgtggttggtgcacggattgcctcgggttcgctgtccgcggtgctgctggcggtggcgtcgtcggcaacgttggcggtattcaccgtgctgaccaaaggggtcgtgacggagctcggcgaggggttcgcgacactgatccggacccccgcgttgtatgcctggatcctggttctaccgatcgggctgatgcttcagcagtcgtcgttgcgggtgggcgcgctaaccgcctcgttgccgacgatcaccgtggcgaggccggtgatcgcttcggtgctggggatcaccgtgctcgatgaggtgctgcacaccggccgggtggccctggtcgcgctggtggcagcggtagtggtggtggttgtcgcgaccgtagccttggcccgtgacgaggtcgcgatgatgacggtttccgccggcgaattgggggccgcgggccagcttgcggttcgttga

SEQ ID NO: 387 - DNA, 1353 bp, Mycobacterium Tuberculosis
atgacggccgacgagccccgcagcgacgattcgtccgggtcggccccccaaccggctgccacgccggtgccccgcccgggaccgcgtcccggcccccggccggtgccgcgacccacctcctacccggtgggtgcgcaccctcccagcgacccgcaccgtttcggccgtatcgacgacgacggcacggtgtggctggtcagtgcgagcggcgagcgtatcgtcggctcctggcaggccggcgatcccgaagccgcgtttgcccatttcggcaggcgattcgatgacctgagcaccgaaatcatgctgatggacgagcggttggcgtccggcaccggcgacgcacgcaagatcaaagcccatgcgatcgcgctggccgaaacgttgccgacggcatgcgtgctgggcgatgtcgacgcgctggcagaccggttgacaagcattcgtgatcgcgcggaggtcatcgctgccgccgaccgctccagacgcgaggaacatcgagccgcccagaccgcccgtaaagaggcgctggccgccgaagccgaggagctggccgccaacgcgacacaatggaaggtcgccggtgaccggctgcgggcaatcctcgatgaatggaagacgattagcggtgtggaccgcaaggtcgatgacgcgctgtggaagcgctactcgacggcccgcgatacgttcaaccggcggcgagggtcccacttcgccgaattggaccgtgagcgatccggcgtccggcaaagcaaggaacggctttgtgaacgggccgaggagttgtccgagtcgacggactggaccgccaccagcgcggagttccgcaagctgctcgccgactggaaagcggcgggacgcgcgagcaaggatgtggacgacgccctgtggcgtcgcttcaaggccgcgcaggactccttcttcacggctcgcaatgccgccaccgccgagaaggaggccgagttgcgagccaatgccgacgccaaggaggcgctgctggccgaagcggagcggctcgacacgacaaaccacgaggccgctcgagcagcgctgcggtcgatcgccgagaagtgggacgcgatcggcaaggtgtcgcgggagcgggccgcggagctggagcggcgactacgcgcggtcgagaaaaaggtgcgagaagccggcgaagcggattggtccgacccgcaggcgcgggcccgcgccgagcagttccgcgcccgggccgagcagtttgaacaccaggccgagaaggcagcagcggccggtcgcaccaaggaagccgacgaggcgaaggcgaacgccgaacaatggcggcagtgggccgaggcagccgccgacgcgttgacccgacgcccctaa

SEQ ID NO: 388 - DNA, 207 bp, Mycobacterium Tuberculosis
atgttggctggcgtgcggctgacggagttccacgagcgggtagccctgcatttcggggcggcttatggctcgtcggtgctgctcgatcacgtgctgaccggcttcgacggccgtagcgccgcccaggccatcgaggacggtgtcgagccccgcgacgtctggcgggcattgtgcgccgacttcgacgttccccacgatcggtggtga

SEQ ID NO: 389 - DNA, 813 bp, Mycobacterium Tuberculosis
atggcagtgaaagcgggtcagcgccggccgtggcgttcgttgctgcagcgcggcgtggataccgccggtgatttggccgacctggtagcacaaaagatcagcgtcgccatcgatccgcgtgcccggctgctgcgccgccgccgccgtgcattgcgctggggtctggtattcaccgcaggctgtctgctctgggggttggtgacggcgctgttggcggcctggggctggtttacgtcgctgctggtgattaccggcacgattgcggtcacgcaggccattccggcgacgctattgctgcttcgctaccgctggctgcgctcggagccactgccggtgcggcggcccgcaagtgtgcgccggctgccaccaccgggctcggccgcgcgacccgcgatgtcggcgctgggcgcctccgaacgcgggttcttctcgctgttgggtgtcatggagcggggcgccatgttgccggcggacgagatccgcgacctaacggccgcggccaaccagacttcggcggcgatggtggcgaccgcggccgaggtggtctcgatggagcgggccgtgcaatgctcggcggcgtcgcggtcgtatctggtgccgaccatcaacgcgtttaccgcgcagctgagcaccggcgtccgtcagtacaacgaaatggtcaccgccgcagcgcaattggtttcctcggcgaacggcgcgggtggggctgggcccggacaacagcgctaccgcgaggagttggccggcgccaccgatcgcctggtcgcttgggcgcaggcgtttgacgagctcggcggattgccccggcgttag

SEQ ID NO: 390 - DNA, 813 bp, Mycobacterium Tuberculosis
atggccaatccgttcgttaaagcctggaagtacctcatggcgctgttcagctcgaagatcgacgagcatgccgaccccaaggtgcagattcaacaggccattgaggaagcacagcgcacccaccaagcgctgactcaacaggcggcgcaagtgatcggtaaccagcgtcaattggagatgcgactcaaccgacagctggcggacatcgaaaagcttcaggtcaatgtgcgccaagccctgacgctggccgaccaggccaccgccgccggagacgctgccaaggccaccgaatacaacaacgccgccgaggcgttcgcagcccagctggtgaccgccgagcagagcgtcgaagacctcaagacgctgcatgaccaggcgcttagcgccgcagctcaggccaagaaggccgtcgaacgaaatgcgatggtgctgcagcagaagatcgccgagcgaaccaagctgctcagccagctcgagcaggcgaagatgcaggagcaggtcagcgcatcgttgcggtcgatgagtgagctcgccgcgccaggcaacacgccgagcctcgacgaggtgcgcgacaagatcgagcgtcgctacgccaacgcgatcggttcggctgaacttgccgagagttcggtgcagggccggatgctcgaggtggagcaggccgggatccagatggccggtcattcacggttggaacagatccgcgcatcgatgcgcggtgaagcgttgccggccggcgggaccacggctacccccagaccggccaccgagacttctggcggggctattgccgagcagccctacggtcagtag

SEQ ID NO: 391 - DNA, 630 bp, Mycobacterium Tuberculosis
atgagcaggtcaacccgttattctgttgccgtgtcggcgcagcctgaaacgggtcagatagcaggccgcgcccgcattgccaacctcgccaatatcctgacgctgttgcggctggtgatggtcccggtcttcctgctggccttgttctatggcggcggccaccactccgcggcccgcgtagtggcgtgggcgatatttgcaaccgcctgcattaccgatcgattcgacggcctgctggctcgcaattacgggatggcaaccgaattcggtgcgtttgtcgatccgatcgcggacaagactctgatcggctcggcgctgatcggattgtcgatgctcggcgacttgccgtggtgggtcacggtgctaatcctgacccgcgaactcggagtgaccgttttgaggttggcggttattaggcgcggtgtcattcccgcgagctggggcggcaagctgaagacctttgtccaggcggtggcaattggcttattcgtgttgccactttcgggtccgctgcacgttgcggcggtggtagtgatggccgccgcgatcctgctcaccgtgatcactggtgtcgattacgtggccagggctctgcgggacatcggggggatccgccagaccgccagctga

SEQ ID NO: 392 - DNA, 315 bp, Mycobacterium Tuberculosis
atgcccgtcgtcgtcgtcgccacgctgaccgccaagcctgaatcggtcgacaccgtccgcgacatcctcacccgcgcggtcgatgacgtgcaccgcgaacccggctgccagttgtacgcgctccacgaaaccggcgagaccttcatcttcgttgagcaatgggccgatgccgaggcgctcaaggcccatagcggcgcccccgcggttgccaccatgtttaccgcggccggcgagcacctggtcggggcgccggacatcaaactgctgcagccggttcccgccggcgacccgagcaaagggcagctgcgccggtga

SEQ ID NO: 393 - DNA, 903 bp, Mycobacterium Tuberculosis
gtgaccaccgtcggattcgacgtcgcagcgcgcctaggaaccctgctgaccgcgatggtgacaccgtttagcggcgatggctccctggacaccgccaccgcggcgcggctggccaaccacctggtcgatcaggggtgcgacggtctggtggtctcgggcaccaccggcgagtcgccgaccaccaccgacggggagaaaatcgagctgctgcgggccgtcttggaagcggtgggggaccgggcccgtgttatcgccggtgccggcacctatgacaccgcgcacagcatccggctggccaaggcttgtgcggccgagggtgcgcacgggctgctggtggtcacgccctactattccaagccgccgcagcgggggctgcaagcccatttcaccgccgtcgccgacgcgaccgagctgccgatgctgctctatgacatcccggggcggtcggcggtgccgatcgagcccgacacgatccgcgcgttggcgtcgcatccgaacatcgtcggagtcaaggacgccaaagccgacctgcacagcggcgcccaaatcatggccgacaccggactggcctactattccggcgacgacgcgctcaacctgccctggctggccatgggcgccacgggcttcatcagcgtgattgcccacctggcagccgggcagcttcgagagttgttgtccgccttcggttctggggatatcgccaccgcccgcaagatcaacattgcggtcgccccgctgtgcaacgcgatgagccgcctgggtggggtgacgttgtccaaggcgggcttgcggctgcagggcatcgacgtcggtgatccccggctgccccaggtggccgcgacaccggagcagatcgacgcgttggccgccgacatgcgcgcggcctcggtgcttcggtga

SEQ ID NO: 394 - DNA, 1317 bp, Mycobacterium Tuberculosis
atgccgcgacggtcaccagctgaccccgcggcggcgctggcgccgcggcgcaccaccctgccgggcgggctgcgagtggtcaccgaattcctgcccgcggtgcactccgcgtcggtcggggtgtgggtcggcgtcggatcgcgcgacgaaggcgccacggtggccggggcggcgcacttccttgagcatttgctgttcaagtcgacgcccacccgctctgccgtggacattgcgcaggcgatggacgcggtgggcggggaactgaacgcattcaccgccaaggagcacacctgctactacgcccacgtgctcggcagcgacttgccgttggccgtcgacctggtcgccgatgtggtgctcaacggccgctgtgccgccgacgatgtcgaggtggaacgtgacgtcgtcctcgaggagatcgcgatgcgcgacgacgaccccgaggacgccttggcggacatgttcctggcggcgttgttcggcgaccacccggtcggtcgcccggtgatcggcagcgcgcaatccgtgtcggtgatgacgcgggctcaactgcaatcgtttcacctgcggcgctataccccggagcggatggtcgtcgcggccgccggcaatgtggatcacgacgggctggttgcgttggtccgcgagcacttcgggtcccggttggtccgggggagacggccagttgcgccgcgcaagggtaccggccgggtcaacggcagcccccggttgacactggttagccgcgacgccgaacagacgcatgtgtcgctgggcatccgcacacccgggcgcggctgggagcatcgttgggcactgtcggtgctgcacaccgcgctgggcggtggcttgagttcccggctgttccaggaggtccgcgagacccgcgggctggcctactcggtctactccgcgctggatctcttcgccgacagcggcgcgctttcggtgtacgcggcctgcctgcccgaacgcttcgccgacgtgatgcgggtgaccgccgatgtgctggaaagcgtggcacgcgacggcatcaccgaggcggaatgcggcatcgccaagggatcgctgcggggtgggctggtgctagggctggaggattccagctcccggatgagccggctcggccgcagcgagttgaactacggcaagcaccgcagcatcgaacacaccttgcggcaaatcgagcaggtcaccgtggaggaggtcaacgcggtggcccgccacctgctgagcaggcgctacggtgctgccgttcttggcccacacggatcgaaacgatcactgccgcaacaacttcgagcgatggtagggtag

SEQ ID NO: 395 - DNA, 582 bp, Mycobacterium Tuberculosis
atgaatctggcggtgtgggctgagcgcaacggtgttgcgcgggtgactgcgtatcgctggtttcatgcggggttgttgccggtgccggcgcggaaggccgggcggctgattctcgtggacgaccagccggccgatagatcccgccgggcgcggacggccgtgtatgcgcgagtgtcgtcagcggatcagaagccggacctggatcggcaggtggcgcgggtgaccgcctgggccacgaccgagcagatcgcggtcgacaaggtcgtgaccgaggtcggttcggcgctgaacgggcaccgccgaaagtttcttgcgctgctgcgtgacccatcggtgaagcggatcgtggtggaacaccgagaccggttctgccggttcggctctgagtacgtcgaagcggcgctggccgcccaaggccgcgagctggtcgtggtcgactcggccgaggttgatgacgacctggtacgggacatgaccgagatcttgacctcgatgtgcgcccggctgtacggcaagcgcgctgcgcagaaccgggccaagcgcgcattggcggccgccgccgaagagtcggaggctgcctga

SEQ ID NO: 396 - DNA, 1044 bp, Mycobacterium Tuberculosis
atggcacgtcaacctctggagcagcgggtggcccgggcggcgcaggcggcgctggcccgacagcggttcgtcagcgcgatcgatgtgctgctcggcctgggctggctggcgccctcgcatgtcgaccagtggcggcagggccgcgtcgactcgctggagcaagtcgtacaggccaacctcagcaagatcaccgccgtgatggccgcgttgcggcgctgggcccgcgaccgggggctcaacccgtcggagaccgattacgtcgctcgcactcgggaccgccgtcggctgcggttcagcgtcaccggcgaggacgccatcgagcgcgcgtatcgcacgcattgggtgtcgccggagctctcggagcgtgcggtcgcgcggcagagccggcgccccgatttggtcgtgatcatgccggtcaacgactggtcatgcgcgtcgtgtggcggcagcggtgacctgatgttccttgaggacgcggggccgttgtgcctggactgcgcggaccttggccatctggtcttcttgccgtccggggacgccgcgcttacccgccgggccaagcgggcgagccggctttcggcggtggtggtgcggtggagccgggcgcgtaagcgatacgagcgtcagggcatcctggtcgaggcggaggcgctggagcgcgccgaaaacgagtgcctcgccgatgcggaggtgcgcgcccgccgccgggagcgcgacgaggcgcgacgggccaacgaggacctgcgtctgcaagccgaattcggcgccgcgattcgcacgctgttcccgaactgcccggccggccgggccgaggcgatcgcccgccacgcggccacccgcggcagcggcaggatcggacgtagcgcggccggacgggcgctcgatcccgaagcggtgaggctggccgtcgcggcgtcggtgcggcatatcgacacttcgttcgacgaactgctgatgtcgggtgtcgaccgggaaacggcgcggcaccgggtgggtgagcacgtcgaggaagtgctgcgcgactggcgcgcgaccagccgctga

SEQ ID NO: 397 - DNA, 468 bp, Mycobacterium Tuberculosis
atgacctgcccgagcctagtcggactgcgcaccgaggccgcggaactgagttactccgaccagccggacgcgctcggagtggcgatgcgcgaacgtcgggaacaacagaacctcgttcggccgccacggagaaacgcttctcgccgcatcaacaccgatcagacgtcgacgaagtacgtctacattacgtacatgcccgagactctgactggtcgcctcaacttccgcctgtctcctgaacaggagcaggcccttcgccacgccgccgcgctcaccggccagagcctgtcggggttcgtattgtccgccgcggtcgaccacgcccacgatctcttggcccgggccaaccggatcgagctgtccgaggccgctttccgccgcttcgtcgccgcgctcgacgagcccgacgaggcggctcccgaattggtgcgcctcgccagacggaagagccgcattcccccccattga

SEQ ID NO: 398 - DNA, 375 bp, Mycobacterium Tuberculosis
atgagcgtcatccaagacgactatgtgaaacaggccgaagtaattcgcggcctgccaaagaaaaagaacggcttcgagctgaccacaacccagctgcgggtgctactcagcctgaccgcacagctcttcgacgaggcgcagcagagcgccaaccccacgctcccgcgtcagctgaaggagaaggtccagtacctgcgggtccggttcgtctaccagtccgggcgtgaagacgcggttaagacattcgtccgaaacgcgaaactcctagaagcgctggaagggataggcgatagccgcgacgggctgctgcgattctgccggtacatggaagccctagccgcatacaagaagtacctcgatccgaaggacaagtga

SEQ ID NO: 399 - DNA, 546 bp, Mycobacterium Tuberculosis
gtgacgccagcgctgaaggagtggagcgcggcggtgcacgcgctgctggacggccggcagacggtgctgctgcgtaagggcgggatcggcgagaagcgcttcgaggtggcggcccacgagttcttgttgttcccgacggtcgcgcacagccacgccgagcgggttcgccccgagcaccgcgacctgctgggcccggcggccgccgacagcaccgacgagtgtgtgctactgcgggccgcagcgaaagttgttgccgcactgccggttaaccggccagagggtctggacgccatcgaggatctgcacatctggaccgccgagtcggtgcgcgccgaccggctcgactttcggcccaagcatcggctggccgtgctggtggtctcggcgatcccgctggccgagccggtccggctggcgcgtacgcccgagtacggcggttgcaccagctgggtgcagctgccggtgacgccgacgttggcggcgccggtgcacgacgaggccgcgctggccgaggtcgccgcccgggtccgcgaggccgtgggttga

SEQ ID NO: 400 - DNA, 1044 bp, Mycobacterium Tuberculosis
atgaacatcgacatggctgctctgcatgccatcgaggtggaccggggtatctcggtcaatgaactgctcgaaacgatcaagtccgcgctgttgactgcctaccggcacacccaaggtcaccagaccgatgcgcgcatcgagatcgaccggaaaaccggtgtcgttcgggtgatcgcccgtgagaccgatgaggctggcaatctcatcagcgagtgggacgacactccagagggcttcggccggatcgccgccacgacggcacgccaagtgatgttgcagcgattccgcgacgccgagaacgagcgcacctacggcgagttctccacccgcgagggcgagatcgttgcgggagtgatccagcgcgatagccgggccaacgcccgcggtctggtcgtcgtccggattggcaccgagaccaaggcttccgagggtgtgatcccggccgctgagcaggtaccgggggagagctatgaacatggcaaccggctgcgctgctacgtagttggtgtaacccgaggtgcccgcgagccgctgattacgctgtcgcgcacgcaccccaatctggtgcgcaagctgttctcgctggaagtccccgagatcgccgacggatcggtggagatcgtcgcggtggcccgggaggccggccaccgctccaagatcgctgtgcggtccaacgttgccggcttgaacgccaagggtgcttgcatcggtccgatggggcaacgggtccgcaacgtgatgagcgagctgtccggggagaagatcgacatcatcgactatgacgacgatccggcgcgttttgtcgccaacgcgttgtcgccggccaaggtggtgtcggtgtcggtgatcgaccagaccgcccgggccgcccgcgtggtggtgcccgatttccaattgtcgctggcaatcggaaaggaagggcagaacgcccggctggctgcccggctcaccgggtggcgtatcgatattcgcggcgatgcgccgccgcccccgcccggtcagcccgaacccggagtcagccgcggtatggcgcacgaccgctag

SEQ ID NO: 401 - DNA, 552 bp, Mycobacterium Tuberculosis
gtgaccaccgggctaccttcgcagaggcaggtgatcgagctactcggtgcagatttcgcgtgcgccggctacgagatcgaagacgtggtcatcgatgcgcgggcccgcccgccgcggatagcggtgatcgccgacggtgacgcccctctcgacctggatacgatagccgcattgtcgcgcagggcatcggctttgctggacggcctggacggtgcgaacaagatccggggccgctacctgctcgaggtcagctctcccggtgtggaacgcccgctgaccagcgaaaagcacttccgccgtgctcgaggccgcaaggttgagctggtgttgtcagacggatcgcgactgaccggccgggtcggcgagatgcgtgctggcacggtggcgttggtgatccgggaagaccggggctgggcagtccgtgagatcccgcttgctgagattgtgaaagctgttgtccaggttgagttttcgccaccggctccggcggagttggaactggcccagtcttccgagatggggctggcccgcgggacggaggccggagcatga

SEQ ID NO: 402 - DNA, 546 bp, Mycobacterium Tuberculosis
gtgcttagagcagcaccagtcatcaaccggctcacgaatcgacccatcagcaggcggggtgtgctggccggtggcgccgcgctggccgcactgggagtggtgtccgcctgcggcgagtccgcgcccaaggcacccgcggtcgaagagctgcgctcgccgttggaccaggcccgacacgacggtgcgctcgcagctgccgccgccacagccatcgggatcccgccgcaggttgccgccgcgctgaccgtcgtcgccactcagcgaacctcgcatgctcgagcgctggccaccgagatcgcccgggccgcgggcaagctggtatccgctacgagcgaaaccagcagctccagtcccagcccaaccgatccggcggcaccgccaccagcggtgtccgacgtgatcgattcgctgcgcacgtcagcgggggaagccagtcgactagtggcgacgacatcgggctaccgagcagggttgctcgcctccattgccgcgtcctgcaccgcctcctatacggttgcgctcgtgccttcaggcccgtcgatatga

SEQ ID NO: 403 - DNA, 1218 bp, Mycobacterium Tuberculosis
gtgaccgagaacccctatctggtcgggttacggctggctggcaagaaggtcgtcgtggttggcgggggcacggtcgcccagcgccggttacccctgctgatcgccagtggcgcggacgtgcacgtgatcgcccccagcgtcacccccgccgtcgaggcgatggaccagatcaccttgtcggtgcgtgactaccgcgacggcgaccttgacggcgcctggtatgcgatcgcggccaccgatgacgcgcgggtgaacgtggctgtcgtcgccgaggcggagcgccgacggatcttttgcgtccgggccgatatcgcggtggaggggacggcggtgaccccggcgtcattcagctatgcgggcctgtcggtgggggtgctcgccggtggtgagcaccgccgttcggcggcgatccgctcggcaatccgggaggcgttgcagcagggcgtcatcactgcgcagagttccgacgtcctcagcggcggagtggcgttggtcggcggcggtcccggcgatcccgaactgatcacggttcgcggtcgccggctgcttgcccaggccgatgtcgtggtcgccgaccggctcgccccgcccgaactgctggccgagctgccgccgcacgtagaagtcatcgacgcggccaagatcccttacggccgggccatggcccaggacgcgatcaacgctgtcctgatcgaacgggccagatccggcaactttgtggtccgtctcaaagggggcgaccccttcgtgttcgcccggggctatgaagaagtgctggcatgtgcccacgccggaatcccggtcaccgtggtgccaggtgtgacgagtgccatagccgtgcccgctatggcgggcgttccagtcactcaccgggccatgacccacgaattcgtggtggtcagtggccatcttgcgcccggtcatcccgaatcgttagtgaattgggatgcattggctgcattgacgggcaccatcgttttgctgatggcggtcgaacgcatcgagcttttcgttgacgttctgctaaagggtggccgaactgcggatacgccggtactggtggttcaacacggaacgaccgccgctcaacagacgttgcgggccacccttgccgacacgccggagaaggtccgcgcggcggggatccgacctcccgcgatcatcgtgatcggggctgtagtcggcctgagcggcgttcggggtttaaacaattcttaa

SEQ ID NO: 404 - DNA, 1119 bp, Mycobacterium Tuberculosis
atggccagcagccagctcgacaggcagaggtcgcggtcggccaaaatgaaccgcgctctgacagcagcagaatggtggcgtctgggcctgatgttcgcggtgatcgtcgccttgcatctggttggctggctcaccgtgacgctcttggtggagcccgcgcggctcagcttgggcggcaaggcattcggcatcggcgtcgggctgacggcgtacacgctgggcttacggcacgcgttcgacgccgaccacatcgccgccatcgacaacaccacccgcaagctgatgagcgacggacaccgaccccttgccgtcgggttcttcttttcactgggccactccacggtggtcttcgggctggcggtaatgctggtgaccggactcaaggctatcgtcggaccggtcgagaacgactcctcgacgctgcatcactacacaggcttgatcggtaccagcatttccggcgcgttcctgtatttgatcggcatcctcaacgtcatcgtcctggtcggcatcgtgcgtgtcttcgcccacctgcgccgcggcgactacgacgaagccgaactcgaacagcagttggacaaccgcggactgctcatccggttcctcggccgcttcaccaagtcactcaccaagtcctggcatatgtacccggtcggatttttgttcggtctcgggttcgacaccgccaccgagatcgcgctgttggtgctggcgggaaccagtgccgcggccggcctgccctggtatgccatcctgtgcctgcccgtcttgttcgccgccggcatgtgtctgctggacaccatcgacggttcgttcatgaatttcgcgtacggctgggccttctccagccccgtgcgcaagatctactacaacatcaccgtcaccggactgtcggtggcagtcgcactgttgattggcagcgttgagctgctgggcctgatcgccaaccagttgggttggcagggcccgttctgggactggcttggcggcctcgacctcaacaccgtcggcttcgtcgtcgtcgcgatgttcgcgctcacctgggccattgccctgctggtctggcactacggccgcgttgaagagcggtggaccccggcgcccgaccgcacaacttga

SEQ ID NO: 405 - DNA, 1368 bp, Mycobacterium Tuberculosis
atgagtaccacgcaactgatcaatcccgccaccgaggaagtgctggcctcagttgaccacaccgacgccaacgcggtggacgacgccgtgcaacgcgcgcgagcagcgcagcggcgctgggcacggttggcaccggcgcagcgggcggccggcctgcgcgcattcgcggcagccgtgcaagcccacctcgacgaactggccgcgctcgaggtagccaattccggacatccgatcgtgtcggccgagtgggaagccggccacgtgcgtgacgtgttggcgttctatgccgccagcccggaacggttgtccggcaggcagattcccgttgccggcggggtggacgtcactttcaacgaaccgatgggcgtggtcggtgtgatcacgccatggaatttcccgatggtgatcgcgtcctgggccatcgcgccggcgctggccgccggcaacgcggtgctggtcaaacccgccgaactgacgccgctgaccacgatgcggctcggtgagctggccgtcgaggcgggtctggacgaagacctgctgcaggtgttgccgggaaagggcacggtggtcggggagcggttcgtcacccaccccgacattcgcaagatcgtgttcaccgggtccaccgaagtcggcaagcgggtcatggccggtgccgcggctcaagtcaaacgagtgacgttggaactgggtggcaagagcgccaacatcgtcttccacgactgcgacctggagcgcgccgcgacgaccgcgccggccggggtcttcgacaacgctgggcaggattgctgtgcccgaagtcgaatcctggtgcagcgcagcgtttacgaccggtttatggagctgctcgagccggcggtacacagcattgtcgtcggggaccccggatcacgcgccaccgagatgggtccgctggtatcgcgcgcacaccgtgacaaggtcgccggttatgtgcccgacgacgctccggtggcgtttcggggtacggctccggctgggcgcggattttggtttccaccaaccgttctcacacccaaacgcggcgaccgcaccgtcaccgacgaaatcttcgggccggtggttgtagtgctgacgttcgacgacgaggccgacgctatcagcctggccaacgacaccgcgtacgggctgtccggatcgatctggaccgatgacctgtcccgcgcgctgcgggtggcgcgggcggtcgaatccggcaacctgtcggtaaactcgcactcgtcggtgcgcttcaacaccccgtttggcggtttcaagcagtccggtgtgggccgcgagctagggccggacgctccgctgcagttcaccgaaaccaaaaatgtgttcatcgccgtcggggaggagatgtga

SEQ ID NO: 406 - DNA, 381 bp, Mycobacterium Tuberculosis
atgatcttcgtcgataccaacgtcttcatgtatgcggtcggtcgcgatcacccattgcggatgcccgcccgtgagttcctcgagcacagcctcgaacaccaagaccgccttgtcacgtcagccgaggccatgcaggaattgctgaacgcgtatgtgcccgtcgggcggaactcgacgctggactcagcattgaccttggtgcgggcgctgacggaaatctggcccgtcgaggcggccgacgtcgcgcatgcgcgaaccctgcaccaccgccaccccggtctgggcgcgcgcgatctgctacacctggcatgctgccagcgtcgcggtgtcacgcggatcaagacgttcgaccacacactggccagcgcattccgatcatga

SEQ ID NO: 407 - DNA, 1242 bp, Mycobacterium Tuberculosis
gtgaccaactcgaccgacgggcgcgctgacggccggttgcgggtggtggtgctgggcagtaccggctcgatcggcacccaggcgcttcaggtcatcgccgacaatccggaccgtttcgaggtagtcgggctggccgctggcggcgcccatctggacacgttgctgcgacaacgtgcgcagaccggggtgaccaatattgccgtcgctgacgagcacgcggcgcagcgggtcggcgacatcccctaccacggatccgacgccgccacccggctggtcgagcagaccgaggccgacgtcgtcctcaatgcgctggtcggcgcgttgggcctgcgaccgacgttggccgcgctcaagacgggtgcccggctggcgctggccaacaaggaatcgctggtcgccggtggttcgctggtgctgcgggcggcgcggcccggtcagatcgtgccggtcgactccgaacactccgcgctggcccagtgcctgcgcggcggcactcccgacgaggtcgccaagctggtgctgacggcctcgggagggccgtttcggggctggtccgcggccgacctcgagcatgtcacccccgagcaggctggcgcgcatcctacgtggtcgatgggcccgatgaacacgctgaattcggcgtcgctggtcaacaagggacttgaggtcatcgaaacccacctgctgttcggcatcccctacgaccgcatcgatgtcgtggtgcacccccagtcgatcatccattcgatggtcaccttcatcgacggttcgacgatcgcccaggccagtcccccggacatgaagctaccgatttcgttagcgctgggctggccgcgtcgggtcagcggcgccgctgctgcctgtgatttccataccgcgtcgagctgggagttcgagccgttggacaccgacgtcttccccgcggtcgagttggcccggcaggccggcgtagccggtggctgcatgaccgcggtttacaatgcggcgaacgaagaagcagcagcggcgttccttgctggccggatcggcttcccggccatcgtcggcatcatcgccgacgtgttgcacgctgccgaccaatgggccgtcgaacccgctaccgtggatgacgtactcgacgcgcagcgctgggcccgcgagcgagcgcagcgcgcggtatctggtatggcttcggtggcgatcgcaagcacggcgaagccgggcgcagcgggtcgacacgcatcgacgttagaaaggtcctga

SEQ ID NO: 408 - DNA, 663 bp, Mycobacterium Tuberculosis
atgatcaacgttcaggccaaaccggccgcagcagcgagcctcgcagccatcgcgattgcgttcttagcgggttgttcgagcaccaaacccgtgtcgcaagacaccagcccgaaaccggcgaccagcccggcggcgcccgttaccacggcggcaatggctgaccccgcagcggacctgattggtcgtgggtgcgcgcaatacgcggcgcaaaatcccaccggtcccggatcggtggccggaatggcgcaagacccggtcgctaccgcggcttccaacaacccgatgctcagtaccctgacctcggctctgtcgggcaagctgaacccggatgtgaatctggtcgacaccctcaacggcggcgagtacaccgttttcgcccccaccaacgccgcattcgacaagctgccggcggccactatcgatcaactcaagactgacgccaagctgctcagcagcatcctgacctaccacgtgatagccggccaggcgagtccgagcaggatcgacggcacccatcagaccctgcaaggtgccgacctgacggtgataggcgcccgcgacgacctcatggtcaacaacgccggtttggtatgtggcggagttcacaccgccaacgcgacggtgtacatgatcgatacggtgctgatgcccccggcacagtaa

SEQ ID NO: 409 - DNA, 582 bp, Mycobacterium Tuberculosis
atgaaggtaaagaacacaattgcggcaaccagtttcgcggcggccggcctggcggctctggcggtggctgtctcaccgccggcggccgcaggcgatctggtgggcccgggctgcgcggaatacgcggcagccaatcccactgggccggcctcggtgcagggaatgtcgcaggacccggtcgcggtggcggcctcgaacaatccggagttgacaacgctgacggctgcactgtcgggccagctcaatccgcaagtaaacctggtggacaccctcaacagcggtcagtacacggtgttcgcaccgaccaacgcggcatttagcaagctgccggcatccacgatcgacgagctcaagaccaattcgtcactgctgaccagcatcctgacctaccacgtagtggccggccaaaccagcccggccaacgtcgtcggcacccgtcagaccctccagggcgccagcgtgacggtgaccggtcagggtaacagcctcaaggtcggtaacgccgacgtcgtctgtggtggggtgtctaccgccaacgcgacggtgtacatgattgacagcgtgctaatgcctccggcgtaa

SEQ ID NO: 410 - DNA, 1383 bp, Mycobacterium Tuberculosis
gtgatggcgcgcttaaaggtgcctgaggggtggtgtgtgcaggcgtttcggttcacgctgaacccgacccagacgcaagctgccagcttggcgcgccattttggtgctcgccgtaaggcattcaactggaccgtcacggcgcttaaagccgacatcaaggcgtggcgcgcggatggcaccgagtcggcgaagccgtcgctgcgggtgttgcgcaaacggtggaacacggtcaaagaccaggtgtgtgtcaacgcgcagaccgggcaggtgtggtggccggaatgctcgaaagaggcctatgccgatggcatcgcgggcgcggtcgatgcgtattggaactggcagagctgccgtgccgggaaacgggctggcaaaacagtaggcgttccccggtttaagaagaagggacgcgacgccgatcgcgtgtgcttcacgaccggtgcgatgcgtgtggagcccgaccgccgccacctcaccttgccggtgatcggcaccatccgtacgtacgagaacacccgccgggttgagcggctcatcgccaaaggtcgggcgcgggtgctggcgatcaccgtgcgccgcaacggcacccgcctggatgcgagcgtgcgggtgctcgtccaacgcccccaacagcggcgtgtggcgcttcctgattcacgggtgggtgtcgacgttggtgtgcggcgtttggccactgttgcagacgctgagggcacggtgcttgaacaagtgccgaatcctcgcccgcttgatgctgcgttgcgcgggttgcgccgcgtcagccgcgcacgctcacgctgcacgaaaggctcacgccgctactgtgagcgcaccaccgaactgtcccggctgcaccgtcgggtcaacgatgtccgtacccaccacctgcacgtgctgacaacacgattggccaaaacccacggccgtatcgttgtcgaaggtctggatgcggcgggaatgctgcggcaaaagggactgccgggggcgcgcgccagacggcgcgcactgtctgatgcagccctggcaaccccgcgccgtcacctgtcctacaagacaggctggtacggatcgagtctggtggtcgccgaccgctggttcccatcgtcgaaaacctgccatgcctgccggcatgtgcaagacatcggctgggacgaaaaatggcaatgcgacggctgttcgatcacgcaccaacgtgacgacaacgccgcgatcaacctcgcacgctacgaggaaccacctagcgtcgtcggcccagttggggccgccgtcaagcgtggagccgaccgtaagaccgggcctggcccggcgggtggccgtgaagcgcggaaggcaaccggccacccggccggcgaacaaccccgagacggggtgcaagtcaagtga

SEQ ID NO: 411 - DNA, 489 bp, Mycobacterium Tuberculosis
atggctgtgaagatcaagctcactcggcttggcaagatccgcaatcctcagtaccgcgtcgccgtcgccgatgcgcgcacccgccgcgacggccgagcgatcgaggtaatcggccggtaccaccccaaagaagagccgagtctcatcgagatcaactccgagcgtgcccagtactggctctcggtgggtgctcagcccaccgagcccgtcctcaagctgctgaagatcaccggggattggcagaagtttaagggcctacctggcgctcagggccggttgaaggtcgccgcacccaagcccagcaagctcgaggtgttcaacgccgcgttggccgccgccgacggtggtcctaccaccgaggccaccaaaccgaagaagaagtcgccggccaaaaaggctgccaaggctgctgagccagcgccgcagcctgagcagccggacacgccggcgctgggtggcgagcaggccgagctgacggcggaaagctga

SEQ ID NO: 412 - DNA, 588 bp, Mycobacterium Tuberculosis
atggccaggacccagcagcagcgccgcgaagaaaccgttgcacggcttctgcaggccagcatcgacacgatcatcgaggtcggctacgcgcgggcatcggctgccgtgatcaccaagcgggctggggtgtcggtaggcgccctgttccggcacttcgaaacgatgggtgatttcatggcggccacggcatacgaggtgttgcgccgtcagctggaaacgttcaccaagcaagtcgccgaaataccggccgatcggccggcgcttccggcggcgctgacgattttgcgggacatcacggccggctccacgaatgcggtgctctacgagcttatggtcgccgcgcgcaccgacgagaagctcaaggagacgctgcagaatgtgctggggcagtacagcgcgaagatccacgacgccgcgcgtgctctgccgggtgccgagagctttccggaggagacatttccggtcatcgtggcgttgatgaccaacgtcttcgacggcgccgccattgtgcgaggggtactgccgcagcccgaactcgaggaacagcggattcccatgctgacggcgctgctgaccgccggcctatga

SEQ ID NO: 413 - DNA, 2427 bp, Mycobacterium Tuberculosis
atggaggcagaaagtccttgtgccgcaagcgatttagctgtcgcccgacgcgagctgctgtccggcaaccatcgcgagctggatccggtcgggctgcggcagacgtggctggatctgcatgagtcttggctgatcgacaaggccgacgagatcgggatcgccgatgccagtggttttgcaatcgtcggggtcggcgggctcggccgccgcgagctgctgccgtattcggacctggacgtgttgctgttgcacgatggcaagcctgctgacatcttgcggcccgtcgccgacaggttgtggtatccgttgtgggatgccaacattcggctcgatcacagtgtgcgaacggttagtgaggcattgaccatcgccaattccgatctgatggccgctctaggcatgctggaagcccgccacatcgccggcgatcagcagctctcgttcgcgttgatcgacggcgtgcgacgccagtggcgcaacggaattcgttcccgcatgggcgaactcgtcgaaatgacatatgcgcgttggcggcgctgtggccggatcgcgcagcgcgcagagcccgatctcaaattgggtcgcggcggccttcgggacgtccagttgctagacgcgctggctctcgcccagctcatcgaccggcacggtatcggccacacggacctgccggcgggttcgctggacggtgcgtatcgcaccttgctggatgtgcgcaccgaactgcaccgggtgtcgggccgcggacgcgaccacctgctggcccagttcgccgacgagatcagcgccgcgttgggtttcggtgaccgattcgatttggcgcgcacactgtcgagtgctggccgcaccatcggttaccacgccgaagccgggctgcggactgcggcgaatgcattgccgcggcgcggcatctcggccttggtgcggcggccaaagcggcgaccgctcgacgagggtgtcgtcgagtatgccggcgaaatcgtgctcgcccgcgacgccgaacccgaacacgatcccggcctggtgctccgagtggccgccgcgtcggccgacaccggattgcccattggcgccgccaccctgagccggttggccgccagcgtcccggatctgccgactccctggccgcaagaggcattggacgacttactagttgtgctctccgccggccccaccacggtggctaccatcgaagcgctcgaccgaaccgggctctggggccggttgttgccggaatgggagcccattcgcgaccttccgccgcgcgacgtcgcccacaagtggacggttgaccgacacgtggtcgagaccgcggtgcatgcggcgccactggccacccgggtggcacgtcccgacctgcttgcgcttggcgcgctgctgcacgacatcggcaagggacggggcaccgatcacagtgtgctcggggccgaattggtaatcccggtttgcaccaggctggggttgtcgccgccggacgtgcggacgctctccaagctggtccgccaccacctgctgctgccgattacggcaacccgacgtgacttaaacgaccccaaaaccatcgaggcggtgtccgaggcgctgggtggggatccgcaactgctcgaagttttgcacgccctgtcggaggcggactcgaaggccaccggccccggggtgtggagcgattggaaggcgtcactggtcgatgacctggtgcgtcgctgccggatggtgatggccggagagtcgctgcctcaagccgaaccgactgcaccccattatctttcgctggcggccgaccacggggtgcatgtggagattagtccgcgcgacggtgaacgcatcgacgccgtaatagtggcgccggacgagcggggactggtgtcgaaagccgccgcggtgctggcgctgaactcgctgcgcgtacattcggcgtcggtcaacgtccaccagggtgtcgcgataaccgagtttgtggtgtcaccactgtttgggtccccgcccgcggcggagttggtgcgtcagcagtttgtcggtgccctcaacggcgacgtcgacgtgctgggcatgctgcagaagcgggacagcgatgccgccagcttggtatccgctcgggccggggacgtgcaggccggggtgcccgtgactcgtacggccgctccgccccgcatcctgtggctcgacaccgccgcgccggccaagctgatcctcgaagttcgggccatggatcgggcgggtttgctcgcgttgctggccggggcgctggagggcgcgggagccggcattgtctgggcgaaggtcaatacgttcggatcgaccgcggccgatgtgttctgtgtgacggtccccgcggagttggacgcgagagccgcggtcgagcaacacctgctggaggtgttgggcgccagcgtcgacgttgtggtcgacgaacccgtcggcgattag

SEQ ID NO: 414 - DNA, 738 bp, Mycobacterium Tuberculosis
gtgtaccgagtctttgaagcgctggacgaattgagcgccatagtcgaagaagcccgaggcgtgccgatgacggcaggttgcgtcgtcccgcgtggggatgtgctggagttgatcgacgacatcaaggatgcgatccccggtgagctggatgacgcgcaggacgtcctcgacgcacgtgattcgatgttgcaggacgctaagacgcacgctgactctatggtgtcctcggcgaccactgaggcggagtcgatactcaaccacgcccgcaccgaggctgaccggatcctgtctgacgcgaaggcgcaggctgatcggatggtcagcgaggcacgccagcacagcgagcgaatggtcgccgatgcacgcgaggaggcgattcgcatcgccaccgccgcgaaacgcgaatacgaggccagcgtcagtcgcgcccaggccgaatgcgaccggctgatcgaaaacggcaacatctcctacgagaaagccgtgcaggagggcatcaaagagcagcagcgcctggtatcgcagaacgaggtggttgcggcggccaacgcggaatcgacccgcctcgtcgacacggcgcacgccgaggcggaccggctacgcggagaatgcgatatctacgtcgacaacaagctcgccgaattcgaggaattcctcaacggcaccctgcggtccgttggccgcggtcgccaccagctccgcacagcggccggcactcacgactacgcggtgcgctaa

SEQ ID NO: 415 - DNA, 312 bp, Mycobacterium Tuberculosis
atgatcgagcttagctatgctccggatgtagctggccgaagatccaactggccgaagggctcgggggtcaacacctggacagccattcgctggacatttgctgaagattcaccgtacgtcggcaccggtctggagcggatggcttcagacacacacgggggcggtggcggccgaccggtcaccccgcccccgcccggtatgcaccatctcgggtgcagccgaggcgtgttgttaatctcgtcacaacgggacgccggtcacaagacgtgcgacccagccgccggcggcactctgacctcggttcttacctga

SEQ ID NO: 416 - DNA, 6567 bp, Mycobacterium Tuberculosis
atgaccgcagcgacaccagatcgccgagcgatcatcaccgaggcgctgcacaagatcgatgatctcacggcgcgcctggaaatcgccgaaaaatccagcagcgaaccgatcgcggtgatcggcatgggttgccggttcccgggcggggtcaacaaccccgaacagttctgggatttgttgtgcgccggccgaagcggcatcgtccgggttcccgcgcagcggtgggacgccgacgcctactactgtgatgatcacaccgtgccggggaccatctgcagcaccgaaggcggttttctcaccagctggcagccagatgagttcgatgcggagttcttctcaatctccccgcgcgaagcggcggcgatggacccgcagcagcgattgttgattgaagttgcgtgggaagcgctagaagacgcgggcgtcccgcaacacaccattcgcggtacgcaaacctcggtattcgtcggtgtcaccgcctacgactacatgctcacgctggcgggccggctacgacctgttgacctcgacgcgtacatcccaaccgggaactcggcgaacttcgccgccggacggctggcctacatcctcggggcacgcggacccgcggtggtcatcgacacggcctgctcatcgtcgttggtggcggtgcacctggcatgccagagcctgcgcgggcgggaaagcgatatggcgttggtgggtggaaccaaccttttgctgagcccgggacccagcatcgcttgctcgcgatgggggatgctgtcaccggaggggcggtgcaagaccttcgatgcgtccgccgatggatacgtgcgcggcgagggtgccgcggtggtggtgctcaagcggctggatgacgcggtgcgcgacggcaaccgcattcttgccgtggtacgcggttcggcggtcaaccaggacggtgccagcagcggagtgaccgttcccaacgggccagcgcaacaggcgttgctcgccaaagcattgacgtcgtcgaagttgacagcggccgatatcgactacgtcgaggcccatggaactggtactccgctgggcgacccgatcgaactcgattcactgagtaaggttttcagcgatcgagcgggttcggatcagttggtgattggatcggtgaagaccaatctcggtcacctggaagcggcggccggtgtcgccgggctgatgaaagccgtgctcgcggtacacaacggctacattccgcggcatcttaacttccaccagctgacaccacatgcaagtgaggccgcatctcggctgaggatcgccgccgatggtattgactggccaaccaccggtcgacctcgccgggcgggggtgtcgtcgttcggcgtcagtgggacgaatgcacacgtggtgatcgagcaggcacccgatccgatggccgctgcgggaacggagccgcagcgcggccccgttcccgcggtgtcgacgctggtggtgttcggcaagaccgcaccgcgggtggctgcgacggcatcggtgctggcagattggctggacggccccggcgcggcggtgccgctggccgatgtcgcgcacaccctcaaccatcaccgggcccgtcagaccaggttcggcacggtagccgctgtcgatcggcgccaagcggtgatcgggttacgcgcgctggccgcgggtcaatccgcccccggggtggtggcaccccgcgaaggctccatcggaggcggcacggtgttcgtctactcgggacgaggatcgcagtgggccggaatggggcgccaactgctggccgacgagccggcattcgccgctgccatcgccgaactggagccggaattcgttgctcaaggcgggttttcgctgcgcgacgtgatcgccggcggaaaagagttggttggcatcgaacagatccagctgggactgatcgggatgcagctggcgctgaccgcgttgtggcgctcatacggcgtgacacccgatgcggtgataggtcactcgatgggcgaagtggccgccgcggtggtggccggggcgctgaccccggcccagggattacgggtgaccgcggtccggtcgaggctgatggcgccgctgtccgggcagggcacgatggcgttgctggaactcgacgccgaagccactgaggcgctgattgccgactaccccgaggtgagcctggggatctatgcctccccacgccaaaccgtgatttccgggccgccgctattgatcgacgagctcatcgacaaggtgcgccaacagaacggcttcgctacccgagtcaacatcgaggtggccccccacaacccggccatggatgcactgcaaccggcgatgcgttcggaattggccgatctcaccccgcaaccgccgaccatcccgatcatctccaccacctacgccgacctcggcatttccctgggttccggccccaggttcgacgccgagcactgggcaaccaacatgcgcaacccggtacggttccaccaggccatcgctcatgccggcgccgatcaccacaccttcatcgagatcagcgcccacccgctgctgacccactcgatcagcgacaccctgcgcgccagctacgatgtcgacaactatctgagcatcggcaccttgcaacgcgacgctcacgacaccctcgagttccacacgaacctcaacacgacccacaccacccatcccccccagactccccacccccccgaaccccaccccgtgctgcccaccaccccatggcagcacacccagcactggatcaccgccacgtcggccgcttaccacaggcccgacacccacccgttgcttggcgtcggtgtcaccgaccccactaacggcacccgggtttgggaaagcgagctcgaccctgatctgctgtggctcgccgatcacgtcatcgacgatctcgttgtgctgcccggggcggcctacgctgagatcgcgctggcggccgcgaccgacaccttcgcagtcgagcaagatcagccctggatgatcagcgagctcgaccttcggcagatgctgcatgtgaccccaggcaccgtgttggtcaccacgctcaccggcgacgagcagcgatgccaggtcgaaatacgcacccgcagcgggtcttcgggatggaccacccacgccaccgccaccgttgcccgcgccgagccgttagcaccgctggatcacgaaggacagcggcgcgaggtaaccactgccgacctcgaggaccaactggatcccgacgacctgtatcagcgcctgcgcggcgccggccaacagcacggacccgcgtttcaaggcatcgtggggctggccgtcacgcaagctggcgtggcccgtgcgcaagtacggctacccgcatcggccagaacgggttcccgtgagttcatgctgcacccggtgatgatggatatcgcgttgcagacactgggagccacccggacggcgaccgatctggccggcggccaggacgcccggcagggcccatcttccaactcggccttggtggtaccggtgcgtttcgccggtgtccacgtgtacggcgatatcacccgcggggttcgcgcggtcggctctctggccgcagccggtgaccggctggtcggcgaggtagtcctgaccgacgcgaatggccaaccgctgctggtcgtcgatgaagtcgagatggcggtgctcggatccggcagtggcgcaacggaactcaccaaccgcctattcatgttggagtgggagcccgcaccgctggaaaagaccgccgaggctacgggtgccctgttgctgatcggtgaccccgccgcgggtgacccgctgctgcccgcgctgcagtcgtcgctgcgcgaccgcatcaccgacctcgagctggcatccgcggccgacgaagccacgctgcgcgcggcgatcagccgaacctcctgggacgggatcgttgtggtctgtccgccccgagcgaacgacgaatcgatgccggacgaggctcaactggagttggcacgcacacgcacgctgctggtcgccagcgtggtcgagaccgtgacgcgaatgggtgcccgcaagagcccccgactgtggatcgtcacccgtggcgctgcacagttcgacgcaggcgagtcggtcacgttggcgcagaccggcctacgtggcatcgcacgggtgctgacatttgagcattcggagttgaataccaccctcgtagatatcgaaccggacggcaccggctcgctggccgccctggccgaggagttgcttgccggttccgaggccgacgaggtcgccttgcgcgacggtcaacgctatgtcaaccggctggtgcccgcacccaccacgaccagtggtgatctcgccgccgaagctcgccaccaggtggtgaacctggacagctcgggcgcttccagggcagctgtccgactgcagatcgatcaacccggacggctggacgcactaaacgttcacgaggtgaaacggggcagaccgcaaggcgatcaagtcgaggttcgcgtcgtcgccgccggactcaacttcagcgacgtgctcaaagcgatgggcgtgtatccgggactcgacggtgccgcgccggtgatcggcggcgaatgtgtcggctacgtgacggccatcggtgacgaggttgacggcgtcgaggtcggacagcgagttatcgcattcggccctggcacattcgggacccatctggggaccatcgccgatctcgtcgtcccaattccggacacgctagccgacaacgaggcggccacgttcggcgtcgcctatctcaccgcctggcactcgctgtgcgaggtcgggcgcctatcccccggcgaacgcgtgctcatccattccgccaccggcggtgttggaatggcggcggtctcgatcgcgaagatgatcggcgcccgcatctacacgacggccggttcggacgccaaacgggaaatgctttccaggctcggtgtcgagtacgtcggcgactcgcgaagcgtggatttcgctgacgagatcctcgagctgacagacggctacggtgtggacgtcgttctcaattcgctggcgggcgaggcgattcaacgcggcgtgcagatccttgcgcccggtggccggttcatcgaactgggcaagaaggacgtctacgccgatgccagcttgggcttggccgcgctagccaagagcgcgtccttctccgtggtcgacctcgacctgaatctcaagctgcagccggcgcgctaccgccaactcctgcaacacatcctgcagcacgtggcggatggcaaactcgaggtacttcccgtcaccgcatttagcctgcacgatgcggccgacgcattccggcttatggcatccggtaaacacaccggcaagatcgtcatctcgataccccagcacggcagcatcgaggcgatcgctgccccgccaccacttcctctggtcagccgcgacggcggctacctcatcgtcggcggtatgggtggtctcggattcgtcgtcgcgcgctggctggctgagcaaggtgcgggactgattgtcctcaacggacgctcggcccccagcgacgaggtggcagccgctatcgcggagctgaacgcctccggtagccggatcgaggtgatcaccggcgacatcaccgagccagacaccgccgagcggctggtgcgggcggtcgaagacgccgggttccggctggccggggtggtgcacagcgcgatggttctcgccgacgagatcgtgttgaacatgaccgattccgccgctcggcgagtgttcgccccgaaggtcaccggcagctggcggcttcatgtggccaccgccgcgcgcgacgtcgactggtggctgaccttctcctcggccgccgcgctgctgggcactcccgggcagggcgcgtacgccgccgccaactcgtgggtcgacggcctggtcgcgcatcggcgctcggccggacttcccgctgtcgggatcaactggggcccgtgggccgacgttggacgcgcgcagttcttcaaagacctcggggtggagatgatcaacgccgagcaggggcttgccgccatgcaggcggtactcaccgccgatcgcgggcgcaccggtgtgttcagcctcgacgcgcggcagtggttccaatcgttccccgctgtggcggggtcctcgctgttcgcgaagctgcatgactcggcggcccgcaaaagtgggcagcggcgcggcgggggcgcgattcgcgctcagctagacgccctcgacgcggccgaacgcccaggccacctcgcgtccgcgatcgccgacgagatccgtgcggtgctgcgctcaggcgatcccatcgatcaccaccgaccgctggaaaccctgggactcgactcgctgatgggcctggaattgcgcaatcggctggaagcaagtctgggcatcacgttgccggtcgcgttggtgtgggcatacccgacgatcagcgatctcgcgaccgccctgtgcgaacgaatggactacgcgacacccgcggctgcgcaggagatttccgatacagaacccgaactgtccgacgaggagatggatttgctcgccgatctggttgacgccagcgagctggaagctgcgacgcgaggcgagtcatga

SEQ ID NO: 417 - DNA, 5484 bp, Mycobacterium Tuberculosis
atgacaagtctggcggagcgcgcggcgcaactgtcgccgaacgcgcgagcggccctggcgcgcgagctcgtccgtgcgggtacgaccttcccgaccgacatctgcgagccggtggcggtggtgggcatcggctgtcgctttccggggaatgtgactgggccagagagcttttggcagctactggccgacggtgtggacacaatcgagcaggtgccgcctgatcggtgggatgcggacgcgttctacgatcccgatccttcggcgtcgggtcggatgacgacgaaatggggtggtttcgtttccgatgtcgacgcgttcgacgccgactttttcggaatcactcctcgggaagccgtggcgatggacccgcagcatcggatgctgctcgaggttgcctgggaagcgttggagcacgcgggtattccgccggattccttgagcggcactcgaaccggcgtgatgatgggtctgtcgtcgtgggactacacgatcgtcaatatcgagcgcagagccgacatcgacgcgtacctgagcaccggaaccccgcactgtgccgcggtggggcggatcgcgtatctgttgggattgcgtggtccggccgtcgccgtagataccgcttgttcgtcgtcgctggtggcaattcacttggcgtgtcagagccttcgcctgcgtgaaaccgacgtggcattggcgggcggggtgcagctcaccttgtcaccgttcaccgccatcgcgctgtccaagtggtcggcgctgtcaccgaccggccgatgcaacagcttcgacgccaacgcggatggattcgtgcgcggcgagggctgcggcgtggtggtgctcaagcggttggccgacgcggtgcgcgaccaggaccgggtgcttgcggtggtccgcggttcggcaactaactccgatggtcggtccaacggcatgaccgcaccgaacgcgctggcgcagcgtgacgtgatcacatccgccctcaagcttgcggatgttacccctgacagcgtgaactatgtcgaaacacacggcaccggaacggtgttgggggaccccatcgagttcgagtcgctggcggccacttatggcctgggtaaaggccagggcgagagcccgtgcgcattggggtcggtcaagaccaacatcggccacctggaggcggccgccggtgtggctggattcatcaaggcggtgctggcggtgcaacgtgggcacattccccgcaacttgcacttcacccggtggaacccggccatcgacgcgtcggcgacgcggctgttcgtgccgaccgaaagcgccccgtggccggcggctgccggtccacgcagggctgcggtgtcatcgttcggcctcagcgggaccaacgcgcacgtggtggtcgagcaggcacccgacaccgcagtagccgcagccggcggcatgccgtatgtttcggcgctgaacgtctccggcaagacggccgcgcgggtggcgtcggcggcggcggtgctggccgactggatgtcggggccgggcgcggcggcaccactggccgacgtggcacacacgttgaaccggcaccgggcccggcacgccaagttcgccaccgtcatcgcgcgtgaccgcgccgaggcgatcgcggggttgcgagcgctggcggccggacaaccacgcgttggggtggtggattgcgaccagcatgccggtgggcctggccgggtttttgtgtattcgggtcagggctcgcagtgggcgtcgatgggccagcagttgctggccaacgaaccggcgttcgccaaggcggtagccgagctggatccgatattcgttgaccaggttggcttttcgctgcagcaaacgcttatcgacggcgacgaggtggtgggcatcgaccgcatccagccggtgctggtcgggatgcagttggcgctgaccgagttatggcggtcctatggggtgattccagatgccgtgatcgggcactcgatgggtgaggtgtcggcggcagtggtggccggcgcgttgacgcccgagcagggcttgcgggtcatcaccacccggtcgcggttgatggcgcggctgtcggggcagggagcgatggcgctgctcgagctggatgccgacgccgccgaggcgctgattgccggctatccgcaggtgacgctggcggtgcatgcgtcaccgcgccagacggtgatcgccgggccgcccgagcaggtggacacggtgatcgcggcggtagcgacgcaaaaccggttggcgcgccgcgtcgaagtcgacgtggcctcccatcacccgatcatcgatcccatactgcccgagttgcgaagcgcgttagcggatttgactccgcagccgccgagcatcccgatcatttccactacgtacgaaagcgcgcagccggtggcggatgccgactattggtcggccaacctgcgcaacccggtgcgattccaccaggccgtcaccgccgccggtgtcgaccacaacaccttcatcgaaatcagccctcaccccgtgctcacgcacgcactcaccgacaccctggatccggacggcagccatacagtcatgtcgacgatgaaccgcgaactggaccagacgctgtatttccacgcccaactcgccgcggtcggtgtggctgcgtccgagcacaccaccggtcgccttgtcgacctgccccccacaccgtggcaccatcagcgattctgggtcacggatcgttcggcgatgtccgagctggccgcgacccacccgctcctgggcgcgcacatcgagatgccgcgcaacggagaccatgtctggcagaccgatgtcggcaccgaggtctgtccctggttggcagaccacaaggtgttcggtcaacccatcatgccggccgcggggttcgccgagatcgccttggcggcggccagcgaagccctcggcacagccgccgacgccgtcgcacccaacatcgtgatcaaccagttcgaggtggagcagatgctgcccctcgacggccacacgccgctaacgacgcagttaattcgcggcggggacagccagattcgggtcgagatctattcccgcacgcgtggcggagagttctgccgacacgccacggccaaggttgaacaatcgccgcgcgaatgtgcgcacgcgcacccggaagcccaaggtcccgccaccgggacaacagtgtcgccggccgatttttatgccctgctccgccaaaccggccaacaccatggtccggcgttcgcggccttaagccggatcgtgcgcctggccgatggttccgcggaaaccgagatcagcattcccgacgaggcgccgcgccatcccgggtatcggctgcaccccgtggtattggatgcggcattgcaaagcgtgggtgccgcgatacccgacggcgagatcgcggggtcggcggaagccagctatctgccagtgtcgttcgagaccatccgggtgtaccgcgacatcggtcggcacgtcaggtgtcgtgcccacctgacaaacctcgacggcggcaccggaaagatgggcaggatcgtcctaatcaacgacgccggccacatagcggccgaagtggacggcatctatctgcgtcgtgtcgaacgccgtgcggtacccctgccactagagcagaagatcttcgatgccgaatggaccgaaagcccgatcgcagccgtgccggctccggagccagctgccgagacgacgcggggaagttggctggtactcgccgatgcaacggtggatgcgccaggcaaggcccaggccaagtcgatggccgacgacttcgtgcagcagtggcgctcaccgatgcggcgggtgcacaccgccgatatccacgacgaatcggcggtgctggccgcatttgcagaaacggcaggcgatcccgagcacccgccggttggcgtggtggtgttcgtcggcggtgcctcgagtcgactggacgacgagctggcggcggcgcgcgacacggtgtggtcgatcaccacggtggttcgtgcggtcgtcggcacgtggcacggccgatcaccgcggctatggctggtcaccgggggcggactttccgttgccgacgacgagccgggaacacccgcggcggcttccttgaaagggctggtgcgggtgctcgccttcgagcacccggacatgcgcaccaccctggtcgatctggacatcacacaagacccgctgaccgcgctgagcgcggaactgcggaatgccgggagtgggtcgcgccatgatgacgtgatcgcgtggcgcggcgagcgcaggttcgtcgaacggctgtcgcgcgccacgatcgatgtatccaaagggcatccggtggtgcgccagggagcgtcgtacgtcgtcaccggcggcctcggcggtctcggcctggtcgtcgctcgttggctggtggaccgcggcgccggccgggtggtgctgggtggccgcagcgatcccactgacgagcagtgcaacgtcctggccgaactgcagacccgcgccgagatcgtggttgtccgtggcgacgtggcatcgccgggggtggcagaaaagctgattgagacggcccgacagtctgggggccaattgcgcggcgtcgtgcacgccgccgcggtcatcgaagacagcctggtgttctctatgagcagggacaacctagaacgggtgtgggcacccaaggccaccggtgcgctgcgcatgcacgaagccaccgctgactgcgagctcgactggtggctcggattctcttccgccgcttcgctattgggttctcccgggcaagcggcctacgcgtgcgccagcgcgtggctggacgcgctggtcggatggcgcagggcatccggcctgccggccgcggtgatcaactggggtccgtggtcggaggtaggcgtcgcccaggccttggtgggcagtgttctcgacacgatcagtgtcgcagaaggcatcgaggctctcgactcattgcttgccgccgaccggatccgcactggagtggctcggctgcgtgccgatcgggccctggtcgcattcccggagatccgcagcatcagctacttcacccaggtggtcgaggagctggactcggcgggtgacctcggcgactggggcgggcccgacgcgcttgccgacctcgacccgggcgaggcgcggcgcgcggtgaccgagcggatgtgtgcgcgcatcgctgcggtgatgggctacactgaccagtcgactgtcgaacccgccgtgcccttggacaagcccctgaccgagctggggctggattctctgatggcggtacgaatacgcaacggcgcgcgggcggatttcggcgtggaaccgccggtagcgctgatactgcaaggcgcgtccttgcatgacctgacggcggacttaatgcgccaactcgggctcaatgatcccgatccggcgctcaacaacgctgacactattcgcgaccgggcgcgccagcgcgcggcagcgcgacacggagccgcgatgcggcgccgacctaaacctgaagtacagggaggataa

SEQ ID NO: 418 - DNA, 717 bp, Mycobacterium Tuberculosis
gtgagtcagtgtcccggctggccgatcgcgcccgcgccgagaactggagccacgaagaatacctggccgcctgcctgcagcgggaagtgtcagcccgggagtcccatggtggtgagggccgcatccgcgccgcccgcttcccggctcggaagtcgttggaagagttcgactttgagcatgctcgtggcctcaaacgcgacaccatcgcacatctgggcaccctggatttcatcaccgcccgcgataacgtcgtgtttttgggccccgcctggcaccgggaagactcatcttgcggtcggcctggcgatacgcgcgtgtcaggccggtcatcgggtgctgttcgccaccgccgccgaatgggtagcacggctcgccgaggctcaccacgccgggcgcatctacgccgaactcacccggctttgccgctatccgctcctggtggttgacgaagtcggctacattccgtttgagcccgaggccgccaacctcttcttccagctggtgtcctcccggtatgagcgggccagcttgatcgtcacgtccaataaggccttcggccggtggggcgaggttttcggcggcgacgacgtcgttgctgccgccatgatcgaccgcctcgtccaccatgctgaagtcgtcgccctcaaaggcgacagctaccggctcaaagaccgcgacctcggccgcgtcccaccagccggaaccaccgaagaataa

SEQ ID NO: 419 - DNA, 702 bp, Mycobacterium Tuberculosis
atgaatgatggaaaacgggcggtgacgtccgctgttctggtggtgctaggtgcctgcctggcgttgtggctatcaggatgttcttcgccgaaacctgatgccgaggaacagggtgttcccgtgagcccgacggcgtccgaccccgcgctcctcgccgagatcaggcagtcgcttgatgcgacaaaagggttgaccagcgtgcacgtagcggtccgaacaaccgggaaagtcgacagcttgctgggtattaccagtgccgatgtcgacgtccgggccaatccgctcgcggcaaagggcgtatgcacctacaacgacgagcagggtgtcccgtttcgggtacaaggcgacaacatctcggtgaaactgttcgacgactggagcaatctcggctcgatttctgaactgtcaacttcacgcgtgctcgatcctgccgctggggtgacgcagctgctgtccggtgtcacgaacctccaagcgcaaggtaccgaagtgatagacggaatttcgaccaccaaaatcaccgggaccatccccgcgagctctgtcaagatgcttgatcctggcgccaagagtgcaaggccggcgaccgtgtggattgcccaggacggctcgcaccacctcgtccgagcgagcatcgacctcggatccgggtcgattcagctcacgcagtcgaaatggaacgaacccgtcaacgtcgactag

SEQ ID NO: 420 - DNA, 2118 bp, Mycobacterium Tuberculosis
atgcggaatgggaatctagcggggctcctggctgagcaggcatcggaggcgggatggtacgaccggccggccttctatgcggccgatgtggtgactcatggtcaaatccacgacggtgccgcacgtcttggggaagtgctgagaaaccgcggactatccagtggtgatcgggttctgttgtgcctgccggattcgcccgacctggtgcagctattgctggcgtgcctggctcgtggggttatggcgtttctagcgaatccggagctgcatcgcgacgaccacgcgttggccgcacgcaacacggaaccggcgcttgtcgtcacctcggatgcgctgcgcgatcggtttcagccgtcgcgggtggccgaagccgcggaactcatgtccgaggcggctcgagtcgcgcctggaggctacgaaccgatgggtggtgacgcactcgcatacgctacgtatacgtctggtaccacgggtccgccgaaggcggcgattcatcggcacgccgacccgttgacgttcgtggacgctatgtgtcgtaaagccttgcggctcactcctgaagatactgggctatgtagtgcacgcatgtattttgcttacggcctaggaaattcggtctggtttccactcgcgacaggtggttccgcggtcatcaattcggcgccggtaactccagaagcagcggccattctaagcgcgcgatttgggccatcggtgctctacggtgtgccaaatttctttgccagagtcatcgactcatgttctcctgattccttccgttcgcttcgatgtgtggtgtcagccggggaggcccttgagctgggtcttgccgagcggctcatggaattctttggcggcatccccattctggacggtattggatctacggaggtcgggcagacgttcgtatcgaatcgggttgacgaatggcgcctggggacgctgggaagggtgctgccgccctacgagattcgtgttgtagcgccggatggaacaactgccgggcctggggttgagggcgacctatgggtccgcggaccggcgatcgctaagggctattggaatcggcctgattcccccgtcgcgaatgagggttggctcgacacgcgggacagggtgtgtatcgacagcgacgggtgggttacctaccgctgccgcgccgacgacaccgaggttatcggaggggtcaacgttgatccgcgtgaggtcgagcgactcatcatcgaggacgaagccgtggctgaggccgcggttgtcgcggtaagggagtccacgggcgcgtcgacactgcaggcttttctggttgcgaccagcggtgccaccatcgatgggtcggtcatgcgagaccttcaccgcggattgctcaaccgattgtctgcgttcaaggtgccgcataggtttgccgttgttgatcgactccctcgaaccccgaacgggaaattggtgcgtggcgccctgcgcaagcagagtccaaccaaaccgatttgggaactctcgttgactgaacctgggtccggcgtgcgggcgcagcgtgatgacctgtcggcgtccaacatgacgatcgccggaggaaacgacggcggggcgactcttcgcgagcggttggtcgctttgcggcaagaacgtcagcggctggtggtggatgccgtatgcgccgaggccgcgaagatgttaggtgagccagatccttggtcggtcgatcaggatctcgccttctcggagctgggttttgactcgcaaatgacagtcacgctgtgcaagcgattggcggcagttaccggcctgcggttacccgagacggttgggtgggactacgggtcgatatcgggattagcccagtatttggaggccgaactggccggcgggcatggtcgattgaaatcagccggtccggtgaatagcggcgcgacgggtctttgggcaatcgaagagcagttgaacaaggtcgaagagctggtggccgtcatcgccgacggcgagaagcagcgggtggccgaccgtttgcgtgccctgctgggcaccatcgccggcagcgaggcgggcctgggcaagctgatccaggctgcttcgactcctgacgaaattttccagctaatcgattccgaacttgggaagtga

SEQ ID NO: 421 - DNA, 1146 bp, Mycobacterium Tuberculosis
gtgggcggacttcgtttcggttttgttgatgccctcgtgcactcgcggttgccgccgaccctgccggcacggtctagcatggcggccgccaccgtgatgggcgccgactcgtattgggtcggcgaccatctgaatgcgctggtgccgcgctcgattgcgacttccgaatatctcggaattgcggcgaaattcgtgcccaagatcgatgccaattacgaaccgtggacgatgcttggaaacctcgccttcgggttgcccagccgtctgcgactgggcgtgtgcgtgaccgatgcaggtcggcgcaatccagcggtcacagcccaggctgccgcgactttgcacttgcttacccgaggccgagccatattgggtatcggtgtcggggaacgtgaaggcaacgagccctacggtgtggagtggaccaaaccggtggcgcggttcgaagaagccctggccaccattcgcgcgttgtggaattcaaacggggagcttatctcacgtgaatcgccatactttccgttacataacgccttgttcgaccttccgccataccgtgggaaatggcccgaaatctgggtcgcggcccacgggccgcggatgttacgggccaccggacgttacgccgatgcctggattcccattgttgtggttcgtcccagcgactacagtcgcgcactcgaagcggtgcgcagcgcggcgtccgatgccggacgcgacccaatgtcgattactccggcggcggtgcgcggcatcatcactggacggaatcgcgacgacgtggaagaggcgctggaatctgtcgttgtgaagatgaccgcgctcggggtacctggggaagcctgggcgcgtcacggcgtcgagcatccaatgggagccgacttctccggtgtgcaggacatcatcccgcaaaccatggacaaacagacggttttgtcctacgcggccaaggtcccggctgcgcttatgaaagaagtcgtcttcagtggaacccctgacgaagtcatcgatcaagtagcggaatggcgagatcacgggctgcgctacgttgtgctgatcaacggcagtttggttaaccccagcctgcgcaagacggtgacggctgtcctgccgcacgccaaggttttgcgcgggctcaagaagctatga

SEQ ID NO: 422 - DNA, 1350 bp, Mycobacterium Tuberculosis
gtgcgcgtgtcgtgcgtgtacgctacggcgtcgaggtggggcgggccaccggttgctagcgaggtgagaggggacgcggccatcagcacgacaccggacgccgcacctgggcttgccgcacgcaggcgccggatccttttcgtcgcggaagcagtgaccctggctcacgtcgtccggccattcgcgcttgcgcagtcgctggaccctagtcgttatgaagtgcacttcgcctgcgacccgcgctacaaccagcttctaggtccgctccctttccgtcaccatgcgattcacaccatccccagcgagcggtttttcggcaatctgactcagggtcgtttctatgccatgcggacgctgcggaagtacgttgaggcggacctgcgggtcctggatgagatcgcgccggacctcgtcgtcggtgaccttcgcatttcactgtcggtcagcgcccgactggccggcattccttacatcgcgatcgcgaatgcctactggagtccgtacgcgcagcggcgttttccgctgcccgacgtgatatggacccgcttgttcggcgtcaggttggtcaagctcctctaccgcctggaacgccctttgctcttcgccctgcagtgcatgccgctcaactgggtccgccgcaggcacgggctgtcgagtctggggtggaacctgtgccgcattttcaccgacggggaccacaccctgtatgctgacgtgcccgagctgatgcccacctacgacttgccggccaaccacgagtaccttggcccggtcctgtggtcgcccgccgggaagccgccgacatggtgggattcgctgccaaccgaccggccgatcgtgtacgcaaccctgggcacgtccggcgggagaaatctgttgcaactggtgttgaacgcgttggctgagttgccggtgacggtgatcgcggccaccgcgggccgcagtgacctgaagaccgtgccggccaacgccttcgtggcggactacctgccgggtgaggccgctgcggctcgctcggccgtggtggtctgcaatggcgggagtttgacgacccagcaggccttggtggccggggtgccggtgatcggggtcgcgggcaatctcgatcagcacttgaatatggaggccgttgagcgggccggggcgggcgtgctgctgcgaactgagcggctgaagagtcagcgggtggcaggggccgtgatgcaggtgatcagtcggtccgagtaccgacaagccgccgcgcgactcgccgatgccttcggacgagaccgcgttggattcccgcagcatgtggagaatgctctgcgcctcatgccggagaaccggccccggacatggttggccagctag

SEQ ID NO: 423 - DNA, 2229 bp, Mycobacterium Tuberculosis
atgatgagcaatgatcgcaaggtgaccgaaatcgaaaacagtcccgtcacagaggtgcggccagaggagcatgcgtggtatccagacgactcggcgctggcggcaccgcccgctgccacccccgccgcgattagcgaccagctaccctcggatcgctacctgaaccgggagctgagttggctggacttcaacgcgcgcgtgcttgccctggccgccgataagtcgatgccattgctcgagcgcgccaagtttctggcaatcttcgcgtccaatctcgacgagttctacatggtccgggtggccggcctcaaacgccgcgacgagatggggttgtcggtgcgctccgccgacggtctaacaccgcgcgaacaactaggccggatcggcgagcagactcaacagctcgccagccggcatgcccgggtgttcctcgattcggtgctacccgcgctcggcgaggaaggcatctacatcgtcacctgggccgatttggatcaggctgagcgcgaccgattgtcgacctatttcaacgaacaggtcttccccgtcctgaccccgctggccgtcgatcccgcccacccgttcccgtttgtcagcgggttgagcttgaacctggcggtcacggtacgccaacctgaagacggcacccagcatttcgcgagggtcaaggtgcccgacaacgtcgaccgcttcgtcgaactcgctgcacgtgaggccagcgaggaagctgcggggaccgaaggccggaccgcgctgcggttcctgccgatggaggagctgatcgcggccttccttccggtgcttttcccgggtatggaaatcgtcgagcaccacgcatttcgcatcactcgcaacgctgacttcgaggttgaagaggatcgcgacgaggacctactgcaggcgctcgagcgagaactggcccgccgccggttcggttcaccggtgcgactcgagatcgcagacgacatgaccgagagcatgctggagttgctgcttcgcgaactcgacgtgcatcccggtgatgtcatcgaagtgcccgggctgctcgacctatcgtcgttgtggcagatctacgccgtggaccgcccgacgcttaaggatcggacattcgtcccagctacccatcccgccttcgccgagcgggaaacacccaaaagcatcttcgcgacgctgcgcgaaggcgatgtgctggttcaccatccgtatgactcgttctccaccagcgtgcagcgattcatcgaacaggccgcggccgaccccaacgtgctggcgatcaaacagacgctgtaccgcacctccggcgactcgccgatcgtccgggcgctgatcgacgccgccgaagccggaaagcaagtggtggcactggtcgagatcaaggcacgcttcgacgaacaggccaacatcgcctgggcgcgcgcactagaacaagccggcgtgcatgtggcgtacgggctcgtcgggctcaagacgcactgcaagaccgccttggtggtgcgccgcgaaggtccgacaatccggcggtactgccatgtcggcaccggcaattacaacagcaagacagcacgactctacgaggacgtcggactgctgaccgctgcacccgatatcggcgccgacttgaccgacttgttcaattcgctcaccggctactcacgcaagttgtcctaccgcaacttgttggtggccccgcacggaatccgcgccggcatcattgaccgcgtcgagcgggaggtcgcggcgcaccgtgcagagggtgcccacaacggcaaaggccgcatccgactcaagatgaatgcccttgttgatgagcaggtcatcgatgcgctgtaccgcgcgtcgcgagccggtgtgcggatcgaggtggtggtacgcggcatctgcgcgctgcgtccaggtgcgcagggcatttcggaaaacatcatcgtgcgctcgattctcggccgcttcctcgagcactcgcggatcctccatttccgtgccatcgacgagttctggatcggcagcgccgacatgatgcaccgcaacctcgaccggcgagtcgaggttatggctcaagtcaaaaacccgaggctgaccgcgcagctggacgaattgttcgaatccgcactggacccgtgcacccggtgctgggagctcgggcccgacgggcagtggaccgcgtcgccgcaagaaggccatagcgtgcgcgaccatcaggaatcgctgatggaacggcaccgcagcccctga

SEQ ID NO: 424 - DNA, 861 bp, Mycobacterium Tuberculosis
atgtgtgtgacctgggccgaaatgcccaagatcgcagccctgatccgccacatcgaagacctacacgcccgccacggtcgctcgtacatactgagggccgggatctcatccttgttccgctacatcgaaggcgtgcacggcgaaagaccctggggcactgtcttggatgccggtaccggtgtgaaatcgcttcagtggatacagactttgccgaccgagcgctggacggcggtcacggccgcccgcagcctggcggacaagacccgcgccgcgttgggtagcgccatgcgcccgcaggaccgcctgctcgtcggcaactgggtagacgacagccttcttgccggcgagacgttcgacaccatcttggtcgactacctggtcggggccatcgaaggcttcgccccgtactggcaggaccgcgtgttcgagcggttgcgcccgcatctcgccgatcatggtcgtctttacctagtcggcttggagccctacgtgcaattcgagccggaaaccgaaagtggcaaaatcatctgggaaatcggtcgcgtgcgcgacgcctgcctgttgcttgccggcgaacgaccgtaccgagagttcccgctggactggatgctggggcgactgggccttgcgggctttcgcattcttgaagcgcgccgcttccccatccgctaccgagctcgctacgtgaacggccaactcaacatgtgcttggcccgaatcgagcgattctcctccaacgggcttggcatggcaatgcgtgcctatgtggaagaactgcgcgctcgggcattgcagctcaacgagcggcaagacggtctgtggcacggcaatgactatgtgatcgcggtcgaaccgatgtag

SEQ ID NO: 425 - DNA, 1011 bp, Mycobacterium Tuberculosis
atgaaactcgcgatcattgccggtgacgggatcgggcccgaggtaaccgccgaggcggtcaaagtgctcgacgcggttgtgccgggcgtccagaaaaccagctatgacctgggtgcgcggcgctttcatgccaccggcgaggtgctgccggactcggtggtggccgagctgcgcaaccacgacgcgatcctgctcggggcgatcggtgacccgtcggtgccaagcggcgtcttggagcgcggtctgttgctgcgactgcgcttcgagctggatcaccacatcaacctgcgtccggcccggctgtatccgggggtggccagcccgctgtccggcaatcccggcatcgacttcgtggtggtgcgcgagggcaccgagggaccctacaccggcaacggcggggcgattcgcgtcggcacgcccaacgaggtggccaccgaagtcagcgtgaacaccgcgttcggtgtgcggcgtgtggttgccgacgcgttcgagcgggctcgacggcgtcgcaagcatctgacattggtgcacaaaacgaacgtgttgaccttcgccgggggattgtggttgcggaccgtcgacgaggtcggcgaatgctacccggacgtcgaggtggcctaccagcacgtcgacgccgccaccatccacatgatcaccgacccgggtcgcttcgacgtgatcgtcaccgacaacctgttcggcgacatcatcaccgatctggccgcggcggtatgtggcggtatcggcttggcggccagtgggaatatcgacgcgacccgggccaacccgtcgatgttcgagccggtgcatggcagcgcgccggacatcgccggtcagggcatcgccgacccgacggcggcgatcatgtcggtggcgttattgctgtcccaccttggcgaacacgacgcggctgcccgggtggaccgggccgtcgaggcccatttggccacgcgtggcagcgaacggcttgccaccagcgatgtcggcgaacggattgccgccgcgctctag

SEQ ID NO: 426 - DNA, 1857 bp, Mycobacterium Tuberculosis
gtgagcgcaccaaccaagccacactcaccgacattcaagccagagccacacagcgcggcgaatgagccaaagcacccggcggctcgtccgaaacatgttgcactgcagcagcttaccggtgcacaggcggtcatccggtcgctggaggaactcggcgtcgacgtcattttcgggattccgggcggtgcggtgctgccggtgtatgacccgctgttcgactcgaaaaagctgcgccacgtgctggtccgccacgaacagggcgccgggcatgccgccagcggctacgcgcacgtcaccggccgggtgggcgtgtgcatggcaacgtcgggtcccggagcgaccaacctggtgaccccgctggccgacgcgcagatggactcgatcccggtggtcgctatcaccggtcaggtcgggcgggggctgatcggcaccgacgccttccaggaggccgacatctcgggcatcacgatgccgatcaccaagcacaactttctggtccgctccggtgacgacattccgcgggtgctggccgaggccttccacatcgcggcctccggccgtccgggcgcggtgctggtcgacatccccaaggacgtgctgcagggccagtgcacgttcagctggccgccgcggatggagctgcccggctacaagcccaacaccaaaccgcacagccggcaggtccgcgaggccgccaagctgatcgcggccgcgcgcaagccggtgctgtatgtcggcggcggcgtcatccgcggtgaggccaccgagcagctccgggagctggccgagctgaccggcatcccggtggtcaccacgctgatggcccgcggcgcgtttcccgacagccaccggcaaaacctcggcatgcccggcatgcacggcacggtggccgccgtggcggcgctgcagcgcagcgacctgctgatcgcgctgggtacccgcttcgacgaccgggtgaccggcaagctcgactcgttcgcgccggaagccaaggtcatccacgccgacatcgacccggccgagatcggcaagaaccgccacgccgacgtgcccatcgtcggtgacgtcaaggccgtcatcaccgaactgatcgcgatgctgcgccaccaccacattcccggcaccatcgagatggccgactggtgggcatacctgaacggtgtgcgcaagacctatccgctgagctatgggccgcagagcgacggcagcctgagcccggaatacgtgatcgaaaagctcggcgagatcgccgggccggacgccgtcttcgtcgccggcgtcggccagcaccagatgtgggccgcgcagttcatcagatacgaaaagccgcgcagctggctgaactccggcggtctgggcaccatggggtttgccatcccggcggccatgggcgccaagatcgccctccccggcaccgaggtctgggcgatcgacggcgacggttgcttccagatgaccaaccaggagctggccacctgcgcggtcgagggcataccggtcaaggtggcgctgatcaacaacggcaacctgggcatggtgcggcagtggcagagcctgttctatgccgagcggtactcgcagaccgacctggccactcattcgcaccgcatccccgacttcgtgaaactggccgaggccttggggtgtgtggggttgcggtgcgagcgggaagaggacgtcgtcgacgtcatcaaccaggcgcgggcgatcaacgactgcccggtggtgatcgacttcatcgtcggtgccgacgcgcaagtgtggccgatggtggccgcgggcaccagcaatgacgagatccaggccgcccgcggcattcgccccctgttcgacgacatcaccgaaggccacgcctga

SEQ ID NO: 427 - DNA, 840 bp, Mycobacterium Tuberculosis
gtgaccagttcgaatgactcacattggcagcggccggatgattcgcctgggccaatgcctggacggcctgtctcggcaagcctggtcgaccccgaggatgacctgacgccggccagatatgccggggactttggcagtggaaccaccaccgttatcccgccctatgatgccgctagctctggtgtcggcaactccgggtacagcctgatcgaagctgcggagccgttgccctacgtccagccgcagccgggccggcaggtaccggcgggatctgccggaatcgacatggacgacgacgagcgggtacgcgccgcaggtcggcgcggcacccagaatctcgggctgctgatattgcgggtcggtctgggcgcggtccttatcgcccatgggctgcagaaattgttcggctggtgggacggccagggtctggccggattccagaactcgctgtccgacattggttaccagcacgccgagatcctcgcttatgtgagcgctggcggcgagatcgtcgccggagtgctgctggtgttgggtttgtttactccgctggcggccgcgggcgcgctggccttcttgatcaacggcctgctcgccggcatctcggcacagcattcgcggcccgtcgcgtacttcctgcaggacgggcatgaataccagatcaccctggtcgtgatggcggtcgccgttatcttgagtggtcccggccgctacggtctggacgcggcccgcggctgggctcatcggccatttatcggatcgtttgtagcgctgttgggtggcatcgcggcgggtattgccgtatgggtgctgctcaacggggcaaatccgctggcctga

SEQ ID NO: 428 - DNA, 1530 bp, Mycobacterium Tuberculosis
atgactgttgctgccggggcagccaaggccgcaggggctgaactgctcgattacgacgaggtcgtcgcgcgcttccagccggtactcggcctcgaggtgcacgtcgagctgtccactgcgaccaagatgttctgtggctgcaccaccacattcggcggcgagccaaacacccaggtgtgtccggtgtgtctgggcttgcccggttcgctgccggtgctcaaccgggccgccgtggagtcggcgatccgcatcgggctggcgctgaactgcgagatcgtaccctggtgtcgcttcgcccggaagaactacttctaccccgacatgcccaagaactaccagatctcacagtacgacgagccgatcgccatcaacggctacctggacgcgcctttggaagacggcaccacttggcgggtggagattgagcgagctcacatggaagaagacaccggcaagctcacccacatcggcagcgagacgggccggatccacggtgccaccggttcgctgatcgactacaaccgtgccggcgtgccgctcatcgagatcgtcaccaaacccatcgtgggcgccggtgcccgggcgccgcagatcgcccggtcctatgtgacggcgttgcgggatctgctgcgcgcattagatgtatctgatgtccggatggaccagggttcgatgcgctgtgacgccaacgtgtcgctgaagccggccgggacgaccgaattcggcacccggaccgagaccaagaacgtcaactcgctgaagagcgtcgaagtcgccgtccgctacgaaatgcagcgccagggcgctattttggcgtctggtggtcggatcacccaggaaaccagacactttcacgaggccggttacaccagcgcgggccgcaccaaggagaccgccgaggactatcggtacttcccggagccggatttggagcctgtcgcgcccagtcgcgagctggtcgagcgactacgccagacgatccccgaattgccgtggttgagccgcaggaggattcagcaggagtggggcgtttccgacgaggtgatgcgcgatctggtcaacgccggcgccgtcgaattggttgctgccaccgtcgagcacggcgcgtccagcgaggcggcgcgcgcctggtggggaaacttcctggcgcaaaaggccaacgaggccggcatcgggctggacgaactggccatcactcctgcccaggtcgcagccgtggtggcattggtcgatgagggcaagctgtccaacagcttggcccgccaagtcgtggagggtgtgctggccggtgaaggtgagcccgaacaggtgatgactgcgagagggttggcgttggtccgcgacgactcgttgacccaggccgcggtcgacgaggccctggccgcaaatcctgatgtggcggacaagattcgcggcggcaaggtggccgcggccggcgcgattgtcggtgcggtgatgaaggcgacccgcggacaggccgacgcggcccgagtgcgcgaactcgttctagaggcctgcgggcagggttag

SEQ ID NO: 429 - DNA, 1485 bp, Mycobacterium Tuberculosis
gtgacggacatcatccgatccgacgccgcgacgctggccgccaagatcgccatcaaggaggtgtcgtcggccgagatcacccgggcctgcctggatcagatcgaggcgaccgacgagacgtaccacgccttcctgcatgtggcggccgatgaggcgctggcggcggcggccgccatcgacaagcaggtggccgctggagaacccttgccgtcggcgctggccggggtgccgctggcgctcaaggacgtcttcaccaccagcgacatgcccaccacctgcgggtcaaaaatcctggagggatggcgatctccctacgacgccacgctgaccgcgcggttgcgcgccgcggggatcccgatcctgggcaagaccaacatggacgagttcgcgatgggctcgtcgacggagaactccgcttacggtcccacccgcaacccgtggaatctcgaccgggtacccggcggttccggtggcggcagcgcggcggcgctggccgcgttccaggcgccgctggccatcggatccgacaccggggggtcgatccgccagccggccgcgctgaccgcgaccgtcggcgtcaaacccacctacggcacggtgtcgcgctatgggctggtggcctgcgcgtcctcgctggatcagggcggcccgtgtgcgcgcaccgtcttggacaccgcgctgttgcatcaggtgatcgccggccacgacccgcgcgactccacgtcggtcgacgccgaggtgcccgacgtggtgggcgccgctagggccggcgcggtcggggatctgcgtggcgtgcgggtcggcgtggttcgacagctgcacggcggcgagggctaccagccgggcgtgctggcctccttcgaggctgccgtggagcagctaaccgcgctgggcgctgaggtcagcgaggtcgactgcccgcacttcgaccatgccctggccgcctattacctgattctgccctcggaggtgtcgagcaatctggcgcgcttcgacgcgatgcgctacgggctgcgggtcggcgacgacggcacccgcagcgccgaggaggtgatggcgatgacccgggccgccggtttcgggcccgaggtcaagcggcgcatcatgatcggcacctacgcgttgtcggccggctactacgacgcctattacaaccaggcgcagaaggtgcgcacgctgatcgcccgcgacctcgacgcggcgtatcggtccgtcgacgtgctggtgtcgcccacgaccccgaccaccgcgttccggatgggtgagaaggtggacgatccgctggcgatgtacttgttcgacctgtgcacgctgccgctgaacttggccggccactgcggcatgtctgtgccgtcggggctctccccggacgacgggttgccggttggcctacagatcatggcgccggcattggccgacgaccggctctaccgggtgggggcggcttatgaggccgcccgcggcccgctactgagcgccatttag

SEQ ID NO: 430 - DNA, 363 bp, Mycobacterium Tuberculosis
gtgtcgcagagtatgtacagctacccggcgatgacggccaatgtcggagacatggccggttatacgggcacgacgcagagcttgggggccgatatcgccagtgagcgcaccgcgccgtcgcgtgcttgccaaggtgatctcgggatgagtcatcaggactggcaggcccagtggaatcaggccatggaggctctcgcgcgggcctaccgtcggtgccggcgagcactacgccagatcggggtgctggaaaggccggtaggcgattcgtcagactgcggaacgattagggtggggtcgttccggggtcggtggctggacccgcgccatgcgggtccagccacggccgccgacgccggagactaa

SEQ ID NO: 431 - DNA, 291 bp, Mycobacterium Tuberculosis
atgtcgcagattatgtacaactatccggcgatgatggctcatgccggggacatggccggttatgcgggcacgctgcagagcttgggggccgatatcgccagtgagcaggccgtgctgtccagtgcttggcagggtgataccgggatcacgtatcagggctggcagacccagtggaaccaggccctagaggatctggtgcgggcctatcagtcgatgtctggcacccatgagtccaacaccatggcgatgttggctcgagatggggccgaagccgccaagtggggcggctag

SEQ ID NO: 432 - DNA, 1077 bp, Mycobacterium Tuberculosis
gtggttggtgcagccagtgcggatagcgcggcggcggccggtgagcatgaggccgcggcggctggctatgtttgtgcgttggcggagatgccgacgttgccggagttggcggccaaccacctcacgcatgcggtgttggtggcgacgaatttctttgggatcaacacgatcccgatcgcgctcaacgaggccgactatgtgcggatgtgggtccaggcggccaccgtgatgagcgcctatgaggcggtggtgggtgccgcgctggtggccacaccacacaccggcccggcaccggtcatcgtcaaacccggcgccaatgaagccagcaacgccgtggccgccgcaaccataaccccattcccattcggagaattagcgaagtttttggaaatggctgcccaagcatttacagaggtcggcgaattgataatgaagagcgccgaagcctgggctgtgggattcgtcgagctgatcacgggtctggtaaatttcgagccttggctcgtccttaccgggatgatcgatatgtttttcgccacggtaggttttgcgttaggcgtatttgttctggttccgctattagaattcgcggttgtcttggaactggcgatactcagtattggttggattatttcgaatatttttggcgctattccggttttgggggggccgttgttgggggcgttggccgctgctgtggttccgggtgtagctgggttggccggggtggcgggattggccgctctgccggcggtgggtgcggctgctggcgcgccggcggcgttggtgggcagtgtggcgccggtgtcgggtggtgtggtgtcgccgcaggcgcggttggtgtcggcggtggagccggctcccgcgagcacgtcggtgtcggtgctggcttctgatcggggtgctggggcgttggggtttgttgggacggctggcaaggagtcggttgggcagccggcggggttgacggtgttggccgatgagtttggtgatggtgcgccggtgccgatgctgccgggcagctgggggccggatttggtcggtgtggccggtgatggggggttggtgtcagtttga

SEQ ID NO: 433 - DNA, 1248 bp, Mycobacterium Tuberculosis
atgacctcttctcatcttatcgacgccgagcagcttctggctgaccaactcgcacaggcgagcccggatctgctgcgcgggctgctctcgacgttcatcgccgccttgatgggggctgaagccgacgccctgtgcggggcgggctaccgcgaacgcagcgatgagcggtccaatcagcgcaacggctaccgccaccgtgatttcgacacccgtgccgcaaccatcgacgtcgcgatccccaagctgcgccagggcagctatttcccggactggctgctgcagcgccgcaagcgagctgaacgcgcactgaccagcgtggtggcgacctgctacctgctgggagtatccactcgccggatggagcgcctggtcgaaacacttggtgtgacaaagctttccaagtcgcaagtgtcgatcatggccaaagagctcgacgaagccgtagaggcgtttcggacccgcccgctcgatgccggcccgtataccttcctcgccgccgacgccctggtgctcaaggtgcgcgaggcaggccgcgtcgtcggggtgcacaccttgatcgccaccggcgtcaacgccgagggctaccgagagatcctgggcatccaggtcacctccgccgaggacggggccggctggctggcgttcttccgcgacctggtcgcccgcggcctgtccggggtcgcgctggtcaccagcgacgcccacgccggcctggtggccgcgatcggcgccaccctgcccgcagcggcctggcagcgctgcagaacccactacgcagccaatctgatggcagccaccccgaagccctcctggccgtgggtgcgcaccctgctgcactccatctacgaccagcccgacgccgaatcagttgttgcccaatatgatcgggtactcgacgctctgaccgacaaactccccgcggtggccgagcacctcgacaccgcccgcaccgacctgctggcgttcaccgccttccccaagcagatctggcgccaaatctggtccaacaacccccaggaacgcctcaaccgagaggtacgacgccgaaccgacgtcgtgggcatcttccccgaccgcgcctcgatcatccgcctcgtcggagccgtcctcgccgaacaacacgacgaatggatcgaaggacggcgctacctgggcctcgaggtcctcacccgagcccgagcagcactgaccagcaccgaagaacccgccaagcagcaaaccaccaacaccccagcactgaccacctag

SEQ ID NO: 434 - DNA, 741 bp, Mycobacterium Tuberculosis
gtggtcagaatcccccgaccccaccccagtgcaaagccgggggtgaaagtcgacgcccgcagtgaacggtggcgtgagcaccgcaagaaggtgcgcaacgaaatcgtcgacgcggcgttccgcgctatcgaccggctgggccccgagctgagtgtgcgccaaatcgccgaagaggccggcaccgccaagcccaagatctatcggcatttcaccgacaagtccgatttgctcgaggctatcgggatgcgactgcgtgacatgctgtgggcggcgatcttcccgtcgctcgacttagccaccgactctgcccgcgaagttatccggcgcagcgtcgaggagtacgtcaacctcgtcgaccagcaccccaacgtgctgcgggtgttcattcagggccgctcggcaaagcagtccgaggcgacggtacgcaccctcaacgaaggccgggagatcacgctggccatggccgagatgttcaacaacgagctgcgcgagatggagctgaatcgagccgcgctcgaactcgccgcattcgcggcgttcggatcggccgcatcggcaaccgagtggtggttgggccccgaacccgacagcccgcgccgcatgccgcgtgagcagttcgtggcgcatctgaccaccatcatgatgggcgtgatcgtcggcaccgccgaagcgctgggcatcgcggtcgaccctgaccaaccgatccacgacgcggtacccaacaatcccgccgtgcgttga

SEQ ID NO: 435 - DNA, 2082 bp, Mycobacterium Tuberculosis
atgctgaacctgtacgacgcggacggcaagatccagttcgacaaggatcgggaagcagcccaccagtactttttgcagcatgtcaatcagaacacggtcttcttccataatcaggacgagaagctcgactacctgatccgcgagaattactacgagcgtgaggttctcgaccagtactcgcgcaacttcgtcaagacgctgctagaccgcgcctacgccaaaaagttccggtttccgacgtttttgggtgcgttcaagtactacacctcctacacgctgaaaacctttgacgggaagcgctatctggagcgcttcgaggaccgcgtggtcatggtggcgctaacgttggccgccggcgataccgcacttgccgagctgctggtcgacgagatcatcgacggccgcttccagcccgccacaccgacgtttttgaattctggcaagaagcagcgcggggagcccgtgagctgttttttgcttcgcgtcgaagacaacatggagtcgatcggacggtcgatcaactccgcgctgcagctatccaagcgtggcgggggagtggcgttgctgctgaccaacattcgcgagcacggcgcgccgatcaagaacatcgagaaccagtcctcgggcgtcatccccatcatgaagttgctggaggatgcgttctcctacgccaaccagctgggcgctcgtcaaggtgccggcgcggtgtacctgcacgcccatcaccccgacatctaccgattcctggacaccaagcgtgagaacgccgacgagaagatccggatcaagacgctgagtctgggggtggtgatccccgacatcaccttcgagttggccaagcgcaacgatgacatgtacctgttctcgccctacgatgtcgagcgggtctacggtgtgccgttcgctgacatctcggtcaccgagaagtactacgaaatggtcgatgacgcgcgcatccgcaagaccaagatcaaggcacgggagttcttccagacgctggccgagctgcagttcgagtccggctacccctatatcatgttcgaagacaccgtcaatcgcgctaatccaattgatggcaagatcacgcacagcaacctgtgctcggagatcctgcaagtgtctacgccgtcattgttcaacgaggacttgtcgtatgccaaagtgggcaaagacatttcgtgcaacctggggtcgctgaacatcgccaagacgatggactcgccggacttcgcgcagacgatcgaggtggcgatccgcgcgttgaccgcggtgagcgaccaaacccatatcaagtcggtgccctcaatcgagcagggcaacaacgactcccacgcgatcgggctaggacagatgaacctgcacggctacctggcccgggaacgcatcttctacggatccgacgaaggcatcgacttcaccaacatctacttctatacggtgctgtatcacgcgttgcgggcatccaaccgcatcgcgatcgaacgcggcacgcacttcaagggtttcgagcggtccaagtacgcgtccggggaattcttcgacaagtacaccgaccagatttgggagccgaagacccagaaggtacgccagctgttcgccgacgccggcatccgcatcccaacgcaggacgactggcgtcggctcaaggagtcggtgcaagcgcacggcatctacaaccagaacctgcaggcggtgccgccgaccgggtcgatttcctacatcaaccattcgacgtcgtcgattcacccgatcgtgtcgaaggtcgagatccgcaaggaaggcaagatcgggcgggtctactacccggcgccgtatatgaccaacgacaacctggagtactacgaagacgcctacgagatcggttacgagaagatcatcgacacctacgcggcggccacccagcatgtggatcaagggctttcgctgacgttgttcttcaaagacaccgccaccacccgcgacgtgaacaaggcgcagatttacgcctggcgcaaggggatcaagacgctgtactacatccggctgcggcagatggcgttggagggcaccgaggtcgagggttgcgtgtcctgcatgctgtag

SEQ ID NO: 436 - DNA, 1479 bp, Mycobacterium Tuberculosis
atggcgacgatccaccccccggcatacctccttgaccaagccaagcgtcgcttcacgccgtcgttcaacaactttcccggcatgagtcttgtcgaacacatgctgctgaacaccaaattcccggagaagaaactcgccgaaccgccgccaggcagcgggctcaagccggtcgtcggtgacgcggggctgccgatccttgggcacatgatcgagatgttgcgcggcggaccggactatctgatgttcctgtacaagacgaagggtccggtcgtattcggcgactcagctgtgctgccgggtgtcgcagcactgggccctgacgcggcgcaggtcatctactccaaccgcaacaaggactactcgcagcagggctgggtgcccgtgatcgggcccttcttccaccgcggcctgatgctgctcgacttcgaagagcacatgttccaccgacggatcatgcaggaggcgttcgtccggtccaggctcgccggctacctcgagcagatggacagggtcgtctcgcgggtggtcgccgacgactgggtcgtcaacgacgcacgcttccttgtctatccggccatgaaggcgctcacgcttgacatcgcctcgatggtcttcatgggccacgaacccggcaccgatcacgaactggtcaccaaggtgaacaaggcgttcacgattaccacccgtgccggcaacgcggtgatccgcaccagcgtgccaccgttcacctggtggcgaggactgcgagcacgcgagctgctggaaaactacttcaccgcccgagtcaaagagcgccgcgaagcgtcgggcaacgacctgctgacggtgttgtgccagaccgaagacgacgacggcaaccggttctccgacgccgacatcgtcaaccacatgatcttcttgatgatggccgcccacgatacctcgacgtcaacggccacgacgatggcctaccagctggccgcccacccggaatggcagcagcgctgccgcgacgaatcggaccggcatggcgatgggccgctcgacatcgaatccctagagcagctggaatcgctcgacctggtgatgaacgagtcgatccggttggtgacgccggtccagtgggcgatgcggcagacggtgcgcgataccgaactgctgggctactacctacccaagggcaccaacgtgatcgcatacccagggatgaatcatcgcctgccggaaatctggacagacccgctgacattcgacccggaacggtttaccgagccgcgcaacgagcacaagcggcaccgctatgcgttcacgccgttcggcggcggcgtgcacaagtgcatcgggatggtgttcgaccaattggagataaagacgatcctgcaccggctgctgcgccgctaccggctggagctgtcccgtcccgactaccagccccgctgggactacagtgccatgccgatcccgatggacgggatgccgatcgtgctgcgtcccaggtag

SEQ ID NO: 437 - DNA, 2166 bp, Mycobacterium Tuberculosis
atgggtattgcattgaccgacgaccatcgcgagctctccggggtggctcgcgcgttcttgacttcgcagaaggtgcgctgggcggcgcgtgcatcactggacgcggcgggggacgcccgcccgccgttctggcagaacctcgccgagctgggctggctcggcctgcatatcgacgagcgacacggtggctctggctatggcctgtccgagcttgtggtggtgatcgaagagctcggtcgtgcggtggcaccggggctgtttgtgccgaccgtgatcgcctcagcggtggtcgccaaagaaggtactgatgaccaacgggcacggctgttgccggcgctgattgacggaaccctgacggcgggtgtgggactggatagtcaggtgcaggttaccgacggtgttgccgacggtgaggcgggaatcgtgttgggcgccgggcttgccgagctgctgttggttgccgccggtgacgacgtgctggtgttggaacgcggccgcaagggcgtctcggttgatgtgccggaaaactttgatccgacccggcggagtggccgcgtgcgcctggacaacgtgcgcgtcacgaccgacgacatcctgcttggtgcgtatgaatcggctttggcccgcgcgcgcacattgctggccgccgaggccgtcggtggggcggccgactgcgtggacagcgccgtggcctatgccaaggtgcgacagcaattcggccgtaccatcgccacgtttcaagcggtgaagcatcactgcgcgaacatgctggtggccgccgagtcggcgatcgccgcggtctgggatgccgcgcgtgcggcagcagaggatgaggagcagtttcggctggccgccgcggtcgctgcggccctggcgtttccggcctatgcacgcaatgccgagctcaacatccaggtgcacggcggtattggctttacctgggagcatgacgcgcatctgcatctgcgccgggcgttggtgaccgtgggattgttcggcggtgatgcgcccgtccgagacgttttcgagcgcaccgcggctggcgttacccgggcgatcagcttggacctgccggcacaggccgaggagctgcgcgcccgcatccgttcggacgccgctgaaatcgctgctctggaaaaggatgcacagcgcgacaagctgatcgagacgggctatgtgatgccgcattggcccaggccgtggggtcgtgccgcgggcgcggtggagcagttggtgatcgaggaagagttcagcgcggcgggcatcgagcgcccggattactcgatcaccgggtgggtgatcttgacgctgattcagcacggaacgccttggcagattgaaagattcgtcgagaaagcgctgcgccagcaggagatatggtgccaactgttctccgaacctgacgcggggtctgacgcggcctcggtcaagacccgcgcaactcgggtggagggcggctggaagatcaacgggcaaaaggtgtggaccagcggagcgcagtactgcgcgcgtggcctggctaccgtgcgtaccgatccggatgcccccaaacacgctggcatcaccacggtgatcatcgacatgttggcccccggtgtcgaggtgcggccgctgcggcagatcaccggcgactcggaattcaacgaggtgttcttcaacgatgtcttcgtccccgatgaggacgttgtcggggcgccgaactccgggtggacggtggcgcgggcaacgctgggcaacgagcgggtcagcatcggcggcagtggctcgtactacgaagcaatggcggcgaagctggtgcaattggtccagcggcggtcagatgcgtttgcgggcgccccaattcgagtcggcgctttcctcgcagaggatcacgcactgcggctgctgaacctgcgccgtgccgctcgcagcgtcgaaggagccggccctggtccggagggcaacatcaccaagctcaaagtggcagagcacatgatcgagggcgccgccatcgcggccgcgctatgggggcccgagattgcgttgctggacggccccggcagggtgattggccgaacggtgatgggcgcccgtggcatggcgatcgccggcggcacgtcggaggtgacccgcaatcagattgccgagcggatcctgggcatgccgcgtgatcccctgattagctag

SEQ ID NO: 438 - DNA, 477 bp, Mycobacterium Tuberculosis
atggtgttggatggcgtggtgtccgacactcgccgcagccggacgatagcggcccggcagcaaaccatctgggacgtcctggccgactttggttccttgagttcatgggtcgagggcgtcgaccactcctgcgtcttgaaccacggtcccgacggcggagctctaggcagcacccgccgcgtgcaggtcggccgcaacacgctggtggagcgtgtcatcgagttcgacccacccacgacactggcctaccgcatcgagggcctgcccgcccggctgcgcaaagtcaccaaccgctggacactacggccggccgatcctgtaggcgcggtgacggtggtcaccttgaccagcacgatcgaaatcggcggcaacccgctggcgcgtctggccgaacttgtcgtcggccgcgccatggccaagcggtccaacacgatgctcgccgggctggcacaacgattggaggacaaacatggctaa

SEQ ID NO: 439 - DNA, 3333 bp, Mycobacterium Tuberculosis
atgaccgacgttgatccgcacgcgacgcggcgggacctggtcccgaatattcccgcggaactgcttgaggctggattcgacaatgtcgaggagatcgggcgcggcggattcggcgtcgtctaccgctgcgtccagccctcgctggaccgcgccgtcgccgtcaaggtattgagcaccgacctggatcgggacaatctcgagcgcttcctgcgcgagcagcgggccatgggccgcctttccgggcacccgcacatcgtgaccgtcttgcaggtgggcgtgttggcgggtgggcggcccttcatcgtgatgccctaccacgccaagaattcgttggagacgctgattcgccggcacgggccgctggactggcgcgagacgctgtcgatcggcgtcaagctcgcgggagcgctggaagccgcgcatcgcgtcggcaccctgcaccgtgacgtgaagccggggaatatcctgctgaccgactacggggaaccgcagctgaccgatttcggaatcgccagaatcgccgggggtttcgagacggcgaccggggtgattgccggttccccggctttcaccgcgccggaagttctcgaaggagcatcgccgacgcccgcctctgacgtgtactccctgggcgcgacgttgttctgtgcgctgaccggccatgccgcctacgagcgccgcagcggtgagcgggtgatcgcccagttcctgcggatcacctcgcagccgatccccgacctgcggaagcagggactgcccgcggacgtggccgccgccatcgaacgggcgatggcccgccatccggcggatcgtcccgcgaccgcggcagacgttggcgaggagcttcgcgacgttcagcgccgcaacggcgtcagcgtcgacgagatgcccctccccgtcgagctgggcgtggaacgccgacgctcgcccgaggcgcacgcggcgcatcggcataccggcggcggcaccccgacggtcccgacgcctccgacacccgcgaccaagtaccggccgtcggtgcccaccggctcgctggtcacccgcagccggctcaccgacatcctgcgcgccggcggacggcgccggctgatcctcatccacgcgccctcgggattcggcaaaagcaccctggcggcgcaatggcgggaagagctctcgcgcgacggcgccgcggtcgcctggctgacaatcgacaacgacgacaacaacgaggtgtggttcttgtcgcacctgctcgagtcgatccggcgggtccggcccacgctggccgagtcgttggggcacgtgctcgaagagcatggggatgacgccggccgctacgtgttgacttcgctgatcgacgaaatccacgaaaacgacgaccggatcgcggtggtgatcgacgactggcatcgggtgtccgacagccgcacccaagctgccctgggtttcctgctggacaacggatgtcaccacctgcagctcatcgtgaccagctggtctcgcgccggtttgccggtgggcaggttgcggatcggcgacgaactagccgagatcgattcggctgctttgcgcttcgataccgacgaggccgccgcgctgctgaacgatgctggtggtctgcgattgccgcgcgcagacgtgcaggcgctgactacctctaccgacgggtgggccgcggcgctgcggctggccgcgctgtcgctgcgcggcgggggcgacgcgacccaactcctgcgcggactttccggcgccagtgacgtgatccacgaattcctgagcgaaaacgtgctggacaccctggaacccgaactgcgcgaattcctactggtggcatcggtcaccgaacgcacgtgcggcgggctggcctcggcgctggccgggatcaccaatgggcgggcgatgctggaagaggccgagcaccgcggcttgttcctgcaacggaccgaagacgacccgaattggtttcgcttccaccaaatgttcgccgactttctccaccgtcgcctcgaacgtggcgggtcgcaccgggtggcggaactgcaccgcagggcatcggcctggttcgccgagaacggctacctgcacgaagccgtcgaccatgcactggccgcgggcgatcccgcgcgcgccgtcgatcttgtcgagcaggatgaaacgaacctgccggagcagtcaaagatgaccacacttctggcaatcgtgcagaaactgccgacgtcgatggtggtttcacgggcccggctccaactcgccatcgcgtgggcgaacattctgctgcaacggccggcgccggccaccggtgccctgaatcgtttcgaaacggcccttggccgggccgagcttcccgaggcgacgcaggcggatctgcgggccgaggcagacgtgttgcgggcggtcgccgaggtgttcgcagaccgggtcgagcgcgtggatgaccttctcgccgaggcaatgtcgagaccggacaccctgcccccgcgagtccccgggaccgccggcaacaccgcggcgttggccgcgatctgccgcttcgagttcgccgaggtatatccactgctggactgggccgcgccctaccaggaaatgatgggaccgttcggcaccgtttatgcgcagtgcttgcgcggcatggcggccaggaatcggctcgacattgtcgctgcgctacagaacttccgaacggcgttcgaggtcggcacggcagtgggggcccactcgcacgcggcgcggcttgcgggttcgctgctcgccgaattgctctacgagaccggcgatctggccggggctggtcgtctcatggacgagagctatctgctgggttccgaggggggtgcagtggactacctggccgccaggtacgtgatcggcgcgcgggtcaaggcggcccagggggatcatgagggtgcggctgatcgcctgtccaccggaggcgatactgccgtccagctggggctgccgcgcctggctgcccgaatcaacaacgagcggatccggctgggcatcgcgctacctgcggcggtggccgccgatttgctggcaccccgcaccatcccccgcgacaatggaatcgccaccatgacagccgaactcgacgaggactccgcggtgcgcctgttgtccgccggcgactccgccgatcgtgaccaagcctgccaacgggccggtgctctcgccgccgccatcgacggtacgcgcagaccgctggcggcgctgcaggcgcaaatacttcatatcgaaacgcttgccgccaccggacgggaatccgatgcgcgaaacgaactggcgccggtagccacgaagtgcgccgaactcgggctgtcacgtctgctggtcgatgcgggactggcctaa

SEQ ID NO: 440 - DNA, 1107 bp, Mycobacterium Tuberculosis
atgaaaaccaccgcggcggtactgttcgaggcgggcaaaccgttcgagctgatggagctcgatctcgacgggccgggtccgggcgaggtgttggtcaaatacaccgccgccgggctgtgccattccgacctgcacctcaccgatggtgatttaccaccgcggttcccgatcgtgggcggccacgaagggtccggggtcatcgaggaggtgggtgccggcgtcaccagggtcaagcccggagaccacgtggtgtgcagcttcatcccgaactgcgggacttgccgctactgctgcaccggccggcagaacctgtgcgacatgggggccaccatcctggagggctgcatgccggacggcagtttccgattccattcccagggaacagatttcggcgccatgtgcatgctgggcacgttcgccgagcgggccaccgtctcgcagcattcggtggtgaaggtggacgactggctgccactggaaaccgcggtgctggtgggctgcggcgtgccgtccggttggggcaccgcggtcaatgccggaaacctgcgggccggcgacaccgccgtcatctacggcgtcggcggcctgggcatcaacgcggtccagggcgcgaccgccgccggctgtaagtacgtcgtggtggtggacccggtggctttcaagcgcgagaccgcgctcaagttcggcgccacccatgccttcgccgacgccgccagcgcggcggccaaggtcgacgaactcacctgggggcagggcgccgacgcggcgctgatcctggtgggcaccgtcgacgacgaggtggtctcggccgcgaccgcggtgatcggcaagggcggcaccgtcgtcatcaccgggctggcggacccggccaaactcaccgtgcacgtctccggaaccgatttgacgctgcacgagaaaacgatcaagggctcgctgttcggttcctgcaatccgcaatacgacatcgtgcggctgctgcgcctctacgacgccggccagctgatgctggacgaactcgtgaccaccacctacaacctcgaacaggtgaaccagggctaccaggatctgcgggacggcaagaacattcggggcgtgatcgtgcactga

SEQ ID NO: 441 - DNA, 483 bp, Mycobacterium Tuberculosis
gtgtccaagtcgtcgcgtggcggccggcagatcgttgccagcaatcgcaaagcccggcacaactattcgatcatcgaggtgttcgaggccggggttgcgctgcaaggcacggaggtgaagagcctgcgggaagggcaggcgtcgctggccgattcgttcgccaccatcgacgacggcgaagtgtggctgcgcaacgcgcacatcccggaataccggcacggcagctggaccaaccacgagccgcgacgcaaccgcaaactgctgttgcatcgccgccagatcgacaccttggtcggcaagatccgcgaaggcaacttcgccctggtgccgttgtcgctgtatttcgccgaaggcaaggtcaaggttgagcttgcgctggcccgaggcaagcaagcccgcgacaaacgccaggacatggcccgtcgtgatgcccagcgtgaagtgctccgcgagttgggtcggcgcgctaagggcatgacctga

SEQ ID NO: 442 - DNA, 1137 bp, Mycobacterium Tuberculosis
atgccggtaaccttggctgctgtggaccccgaccgtcaagccgacatcgccgccttggactgcaccctgaccacggtggagcgggtgctcgacgtcgagggtctgcgcagccgcatcgagaagctcgagcatgaggcatctgatccgcacttgtgggacgaccagacccgggcgcagcgggtgaccagcgagttgtcgcacacccagggagagctgcggcgcgtcgaggagctaaggcgccgcctggacgacctgccggtgctctacgagctggccgccgaggaagcgggcgcggccgccgccgatgccgtcgccgaggccgacgcggagctcaagtcgttgcgcgccgacatcgaggccaccgaggtgcgcaccctgctgtcgggggaatacgacgagcgtgaggcgctggtcaccatccggtccggcgcgggtggggtggacgccgcagactgggccgagatgctgatgcggatgtatatccgctgggccgagcagcacaaataccccgtcgaggtgttcgacacctcctatgccgaagaagccggcatcaaaagcgccacgttcgccgtgcacgcaccgttcgcctacggcacgttgtcggtcgaacagggcacccaccggctggtgcggatcagcccgttcgacaaccagagccggcgacagacgtcgttcgccgaagtcgaagtgctgccggtggtggagaccaccgaccacattgacatccccgagggcgatgtccgcgtcgacgtctatcgctccagcgggcccggcgggcaatcggtgaacacgacagactcagcggtgcggctcacccacattcccagcggtatcgtggtcacctgccagaacgagaagtcccaactgcagaacaagatcgcggcgatgcgggttctgcaagcaaagttgttggaacgcaagcgcttagaagaacgcgccgagctcgacgcgttgaaggccgacggcggcagctcctggggtaaccagatgcgttcctatgtgctgcacccatatcagatggtcaaggatctgcgcaccgagtacgaggtcggcaatccggcggccgttctggatggagacctcgacggattcctggaagccgggatccggtggcgcaatcgacgtaatgacgactag

SEQ ID NO: 443 - DNA, 1248 bp, Mycobacterium Tuberculosis; identical to SEQ ID NO: 433

SEQ ID NO: 444 - DNA, 303 bp, Mycobacterium Tuberculosis
atgtgctctggacccaagcaaggactgacattgccggccagcgtcgacctggaaaaagaaacggtgatcaccggccgcgtagtggacggtgacggccaggccgtgggcggcgcgttcgtgcggctgctggactcctccgacgagttcaccgcggaggtcgtcgcgtcggccaccggcgatttccggttcttcgccgcgcccggatcctggacgctgcgcgcgctgtcggcggccggcaacggcgacgcggtggtgcagccctcgggcgcgggcatccacgaggtagacgtcaagatcacctga

SEQ ID NO: 445 - DNA, 495 bp, Mycobacterium Tuberculosis
ttgcgctcgcggtcggtgcgctgggatcctcggtgccgacctggtcgcagtggagttggcgatccgcactgcgatgacccggctgggctcctcgctgctggagcagctgctgggcgccgacaccgggcaccggggccagcgcatcgattgcgggcaagggcattgcgcgtggttcgtcggttaccgcgacaagaacctcgataccgtgctggaccgggtccggttgctccgcgcctgctaccactgccgcacctgcgggcgtgggatggcgccccctggatctggaacctggccaccgcgatcctgcccgaagccaccccgatcgtggacctctaccacgctcgccagcacgtccacgacctcgccggccagctcgcacccgccctcggcgaacaccacagtgactggctgaccgcccggctggtcgacctcgactccggcgacatcgaaacgctggttcaacaaccgatcgggcagcacaccggtcacacgtaa

SEQ ID NO: 446 - DNA, 1035 bp, Mycobacterium Tuberculosis
gtgctcaagaacgcagtcttgctggcatgccgggcgccgtcggtgcacaacagccagccctggcgttgggtggccgaaagcggctccgagcacactactgtgcacctgttcgtcaaccgccaccgaacggtgccggccaccgaccattccggccggcaagcgatcatcagttgcggtgccgtactcgatcaccttcgcatcgccatgacggccgcgcactggcaggcgaatatcactcgctttccccagccgaaccaacctgaccagttggccaccgtcgaattcagtcccatcgatcacgtcacggcgggacagcgaaaccgcgcccaggcgattctgcagcgccgaaccgatcggcttccgtttgacagcccgatgtactggcacctgtttgagcccgcgctgcgcgacgccgtcgacaaagacgttgcgatgcttgatgtggtatccgacgaccagcgaacacgactggtggtagcgtcacaactcagcgaagtcctgcggcgggacgatccgtactatcacgccgaactcgaatggtggacttcaccgttcgtgctggcccatggtgtgccgccggatacgctggcatcagacgccgaacgcttgcgggttgacctgggccgtgacttcccggtccggagctaccagaatcgccgtgccgagctagctgatgaccgatcgaaagtccttgtgctgtcgacccctagcgacacgcgagccgacgcactgaggtgtggcgaagtgctgtcgaccatcctactcgagtgcaccatggccggcatggctacctgcacgttgacccatctgatcgaatccagtgacagtcgtgacatcgtgcggggcctgacgaggcagcgaggcgagccgcaagccttgatccgggtagggatagccccgccgttggcagcagttcccgcccccacaccacggcggccgctggacagcgtcttgcagattcgccagacgcccgagaaagggcgtaatgcctcagatagaaatgcccgtgaaacgggttggttcagcccgccttga

SEQ ID NO: 447 - DNA, 333 bp, Mycobacterium Tuberculosis
gtggtgcaaggccgcaccgtgctgtttcgtaccgcggagggcgccaaattattttcagccgtcgcgaagtgcgcggtggctttcgaggcggacgaccacaacgttgccgagggctggagcgtgatcgtcaaggttcgcgcccaggtgctgacgaccgacgcgggggtccgcgaagccgaacgcgcccagttactaccgtggaccgcgacgctgaaacgtcactgtgtgcgggtgatcccgtgggagatcaccggccgccacttcaggttcggtccggaaccggaccgcagccagacctttgcctgcgaggcctcgtcacacaaccagcgatag

SEQ ID NO: 448 - DNA, 807 bp, Mycobacterium Tuberculosis
atgagcgatcctcggccagctcgggcagtggtcgttggtatcgacgggtcaagggcggcaacgcatgcggcgttgtgggcggtcgatgaggcggtgaaccgagacattccgctgcgactggtgtacgtcatcgatccgtcccaactgtccgccgccggcgagggcggtgggcaatcagcggcccgagcggcgctgcacgacgcctctcggaaggtcgaggccaccgggcaaccggtcaagatcgaaacggaggttctgtgcggcaggccgctcaccaagctgatgcaggagtccaggtccgcggcgatgctgtgcgtcggttcggtggggcttgatcatgtccgcggtcgccggggttcggtcgcggcgaccctggctgggtcggccttatgccccgtggcggtgattcacccgtcgccggccgagccagcgacaacctcccaggtcagcgcggttgtcgcggaggtggacaatggtgtggtgctgcggcacgcattcgaggaggccaggctgcgcggagttccgctgcgggccgtggctgtccacgctgctgaaacacccgatgacgtcgaacagggcagccggttggcgcatgtacacctgagccgtcggctcgcccactggacccggctctaccccgaggtgcgggtggatcgggccatcgccggcggcagtgcgtgccgtcatctggccgccaacgcaaagccgggtcagctgttcgtcgcggactcacactccgcgcacgaattgtgcggtgcataccagcccggatgcgccgtacttacggtacgcagtgccaacttgtag

SEQ ID NO: 449 - DNA, 1206 bp, Mycobacterium Tuberculosis
atggcaataaatctggaactgccgcgcaagctgcaggcgatcatcgtcaagacccatcagggcgctgcggagatgatgcggccgatagcccgcaagtacgacctgaaggaacatgcctacccggtcgaactcgacaccctgatcaatttgttcgagggcgccgccgaatcgttcaactttgccggagcccattcgcttcgcgacgaggacgaaggcaaggacgaaaaccacaacggtgccaacatggccgccgtggtacagacgatggaggccagctggggcgacgtcgcgatgatgctgtcgctgccctatcaggggctgggtaacgcagccatctccgcggtagccaccgacgagcagctggagcggctgggcaaagtgtgggcagcgatggccatcaccgaaccggaattcggatcggactcggcggcagtgtcgacgaccgccaccctcgacggcgacgagtacgtgatcaacggcgagaagatctttgtcaccgccggttcccgcgccacccacatcgtggtctgggccacgctggacaaatccttgggccgcccggcgattaagtcgttcatcgtgccccgtgagcatcccggcgtgaccgtcgaacgacttgaacacaaactcggcatcaagggttctgatactgcggtgatccggttcgacaacgcccgtatccccaagggcaacctacttgggaacccggaaatcgaggtcggcaagggctttgccggggtgatggagaccttcgacaacacccggccgattgtggccgccatggccgtcgggatcggccgtgccgcactggaggaaatccgtagtgtcctcaccggggccggcgtggagatctcctacgacaagccctcacacacccagagcgccgcggccgccgagttcctgcggatggaggccgactgggaggccagctacctactgtccctgcgcgcagcctggcaggccgacaacaacatccccaactccaaagaagcctcgatgagcaaggccaaggcgggccggatggccagcgacgtcacctgcaaaaccgtcgaattggcaggaactaccgggtattccgagcaatcactgctggagaagtgggcccgcgactccaagatcctggacatcttcgagggcacccagcagatccagcagctggtggtcgcacgccgactgttgggcctgtcgtcgtccgagctcaaatag

SEQ ID NO: 450 - DNA, 972 bp, Mycobacterium Tuberculosis
atgcgcgcggtacgggtgactcggctggagggaccagatgcggtcgaggtggccgaggtcgaggaacccacgagcgccggtgtggtcatcgaggtgcacgctgccggcgtggccttcccggacgcactgctaacccgtggccgttaccagtaccgcccggagccgccattcgtgctcggcgccgagatcgccggagtggttcgatcggcgccggataacagccaagtgcgttccggagacagggttgtcggcctcacgatgctcaccggcggcatggccgaagtcgcggtattgtcgcccgagcgcgtgttcaagctgccggacaacatgactttcgaggcgggcgcgggcgtgctgttcaacgacctgacggtgtacttcgcgctggcggtccggggccggctgcaggccggtgagacggtgctggtgcacggggcggcaggcgggatcggcacatcgacgttgcgactagcgccggcgctcggggcgtctcgcaccgtcgcggtggtcagcacgcaggagaaggccgagcttgcgacagtggccggggcgacagatgtggtgttggccgaggggttcaaggacgcggtacaggagctgacgaacggccgtggtgtcgacatcgtcgtagacccggtcggcggcgaccggttcaccgattcgctgcgctcgcttgctgcgggaggacggctgttggtcatcggcttcactggcggcgagattcccaccgtgaaggtaaaccgccttctgctcaacaacattgacgttgtcggggtaggctggggcgcctggtcgctgacccaccccgatgcgctggcccagcagtggtcacaactcgagcggctgctacgctcgggcaagctgcctcctcccgaaccagtggtctacccactggaccaagccgctgcggcgattgcatcgctggagaatcgcaccgccaaggggaaggtcgtactacgcgtgcgcgactaa

SEQ ID NO: 451 - DNA, 387 bp, Mycobacterium Tuberculosis
ttgaacgtctacatacccatcctggtactggcggcgctggccgccgccttcgccgtggtgtcggtggtgatcgcgagcctggtcggcccgtcgcggttcaaccggtcaaagcaggccgcctacgaatgcgggatcgagcccgctagcactggagccagaacctccattggccccggcgcggcgagcgggcagcggttccccatcaagtactacctgaccgcgatgttgttcatcgtcttcgacatcgaaattgtgttcctctacccgtgggcggtcagctacgactcgctgggcacgttcgcgctggtcgagatggcgatattcatgctcacggtgttcgtggcctacgcgtatgtgtggcgccgcgggggcctgacgtgggattga

SEQ ID NO: 452 - DNA, 438 bp, Mycobacterium Tuberculosis
atgacctcgtttgcgcacccgggtactcgtgggctctccacggtgttcggactgatgatggtggggtcggccgctgtgggatcgcacgggctggctgttgtcgtggggcttgccgcggtgattgcggtaggggtggcggcggtgtttcgcctggcggcaacgcttgccgtggtgttgtcggtggtgatgatcgtggtgtccggcccgacgcatgtgcttgccgcattgtcggggttttgcgccgccgtctacctggtgtgccgatacggggccggtgttgtcgccgggagctggccgacgaccgttgccgccgttggtttcacgttcgctgggttggctgcgacgtcgttcccgctgcaagtgccatggctgccgttggcggcaccgttggccgtgttggctacctacgtgctggccacccgtccgttctcgaggtga

SEQ ID NO: 453 - DNA, 1272 bp, Mycobacterium Tuberculosis
gtgatccaaacgtgtgaagtcgagttgcgctggcgtgcatcacaactgacgctggcgattgccacctgtgccggagttgcgctagccgcagcggtcgtcgctggtcgttggcagctgattgcgttcgcggcgccgctgctcggcgtgttgtgctcgatcagctggcagcgtccggtcccggtgatccaggtgcacggtgacccggattcgcagcgatgtttcgagaacgaacatgtgcgagtgaccgtgtgggtcacaacggaatccgtggacgccgcggtcgaactcacggtatcggcgttggcgggaatgcagttcgaagctctggaatccgtgtcacgccggacgacaacggtttccgcggtggcgcaacgctgggggcgctatcctatccgggcccgggtcgccgtcgtcgcacgcggtgggttgttgatgggagccggaaccgtcgacgccgccgaaatcgtcgtgtttccgctgacaccgccgcagtcgacgccactgccgcagaccgaattgctcgaccgcctgggagctcatctcacccggcacgtcgggccgggtgtcgaatacgccgacattcgcccatatgtcccgggcgaccagctacgtgccgtgaactgggtggtaagcgcgcgccgtggccgactgcacgtgacaaggcggttgaccgaccgggccgctgacgtggtggtgttgatcgacatgtatcgacagccggcgggtccggcgaccgaggccaccgaacgagtcgtgcggggtgctgctcaggtggtgcaaaccgcgctgcgaaacggtgaccgtgctgggatcgttgcgctgggcggcaatcggccgcgatggctgggcgccgacatcgggcagcgccagttctatcgggtgctcgacaccgtgctcggcgccggggaagggttcgaaaacaccaccgggacgctggctccgcgcgcagctgttcccgcaggagcggttgtcattgcgttttccacgctgctggataccgagttcgcgctggcgttgatcgacctgcgtaaacgcggccacgtcgtggttgctgtcgacgttcttgatagctgtccgctccaggaccaactggatcccctggtggtccggatgtgggcgctgcagcgctccgcgatgtatcgcgacatggccaccatcggggtcgacgtgctgtcctggccggcggatcactcgcttcagcagtcgatgggtgcgttgcccaatcgccgtcgtcgcggacggggcagagctagccgggcgaggctgccatga

SEQ ID NO: 454 - DNA, 330 bp, Mycobacterium Tuberculosis
atgaccatggcccgcaactggcgtgacattcgcgccgatgccgtcgcgcagggccgcgtggatctgcagcgggccgccgtggcacgcgaggagatgcgcgatgccgtcctggcgcaccgcctggccgagatccgcaaggcgctaggccacgcacgtcaggccgacgtcgcggcgctgatgggggtctctcaggcccgtgtctccaagctggagagcggcgacctgtcccacaccgaactcggcaccctgcaggcctacgttgccgccctgggcgggcacctgcgcatcgtcgctgagttcggcgaaaatactgtcgagctgaccgcctga

SEQ ID NO: 455 - DNA, 189 bp, Mycobacterium Tuberculosis
gtgcgacgctcggcgtcgacctgtgggtggaagacgccaacccgccggggtacctcccggcctagcgacagcaaaaccctgatcctcgagttgcccgacgagcgggccgtcgcgatcgtgccggtgccgtcgaagttgtcgctgaaggcggccggcggccctaggggtgcccaaagcggccatggctaa

SEQ ID NO: 456 - DNA, 843 bp, Mycobacterium Tuberculosis
atgtcgccaagagttccccggctgcgttgggatgatcccttccgtgccttggacatgctggcctcgctgtggtcgtcgaccgggatgtcgctggtcagcgcgggagccgcccaggcagttgcggcgccctaccggacgttgttcaccaccttgcagcagctgctcatcggcaaggaagtcacggttcggattggggaccatgacgtggtgctgaccgtcaccgagctggactcggcactggaaccgcaggggctggccgtcggccagctgggcgaggttcgggtggccgctcgcggcatcagctgggatcagcatcatttgcacagcgccgttgccgtcctgcgcaacgtgcacatccgcccgggtgtgccgccgctggtgatcgccgctcccgtcgagttgtcgtccgccctgccgaccgagattttcgatgatgtgctccgtcaagcgacgccgcagctgcgcggtgagttgtccgagagcggagcggcccggctgcgctgggcgcgccggcccgactggggaggtcttgaggtcgacgtcgacgtggcgggcacaacctcccagacgacactgtggctgcgaccgcgcaccgtgatcaccggacaacggcggtggacactgccggcacggacaccggcctaccgagttccactgcctgagctgccgcatgggctgcgcatcaccgacgtcagcctcgcagccgattgtttgcagctctctgcgttgcttccggagtggcgaacggagctgccgctgcgttatctggaaagcgtgattacccaattgagtcagggtgcgctcagctttgtctggccgccgctgcgcagcggcgccgattga

SEQ ID NO: 457 - DNA, 687 bp, Mycobacterium Tuberculosis
atggacaccatgaggcaaaggattttggtcgttgacgacgacgcttcgttggctgagatgctcaccatcgtgctgcggggggaaggcttcgacaccgcggtcatcggcgacggtactcaggctctgaccgcggtgcgcgagctgcgccccgatctggtgttattggatttgatgctgcccggtatgaacggcatcgacgtgtgccgggtgttgcgcgccgattccggtgttccgatcgtgatgctcaccgcaaagaccgacaccgtggatgtggtgctgggtctggagtcgggcgccgacgactacatcatgaagccgttcaagcccaaggagctggttgcgcgggtgcgggcgcggctgcgccgcaacgacgacgaacccgccgagatgctgtccatcgccgacgtagaaatcgacgtaccggcgcacaaggtcactcgcaacggtgagcagatctcgttgacaccgctggaattcgacctgttggtcgcattggcgcgcaagccgcgccaggtgtttactcgtgatgtgctgctcgaacaggtatggggttaccggcacccagccgataccaggctggtgaacgtgcatgtccagcgtctgcgggccaaggtcgaaaaggatcccgagaacccgactgtggtgctgaccgttcgaggagtggggtacaaggccggacctccgtga

SEQ ID NO: 458 - DNA, 1488 bp, Mycobacterium Tuberculosis
atgaccggaaatttggtgaccaaaaattcgctgacccctgacgttcgtaacggcatcgactttaagatcgccgacctgtcactagcggatttcggccgcaaagaactccggatcgccgagcacgagatgcccggcctgatgtcgctgcggcgcgagtatgccgaggtgcaacccctgaagggggcccggatctcgggttcgctgcacatgacggtgcagaccgcggtgttgatcgaaaccctcaccgcgctgggcgccgaagtccgctgggcctcgtgcaacatcttctccacccaggatcacgccgccgccgccgtcgtggtcggcccgcacggcacccccgacgagcccaagggtgtcccggtgttcgcgtggaagggcgagacgctcgaagagtactggtgggccgccgagcagatgctcacctggccggaccccgacaagccggccaacatgatcctcgatgacggcggtgacgccaccatgttggtgctgcgcggcatgcagtatgagaaggccggcgtggtgccgcccgccgaggaggacgaccccgccgagtggaaggtcttcctgaacctgctacggacccgcttcgagaccgacaaggacaagtggaccaagatagccgagtcggtcaagggcgtcaccgaggagaccaccaccggcgtgctgcggctctaccaattcgccgcggccggggatctggccttcccggcgatcaacgtcaacgactcggtgaccaagtccaaattcgacaacaagtacggcactcggcactccctgatcgacggcatcaaccgcggcaccgacgcgctgatcggcggtaagaaggtcctcatctgcggctacggcgacgtcggtaagggctgtgcggaggcgatgaagggccagggagcgcgggtctccgtcaccgagatcgacccgatcaacgcgctgcaggccatgatggagggcttcgacgtggtcaccgtcgaggaggccatcggggacgccgacatcgtcgtaaccgcgaccggcaacaaagacatcatcatgctcgagcacattaaggcgatgaaggaccacgcgatcctgggaaatatcggccacttcgacaacgagatcgacatggccgggctggagcgctccggggcgacacgggtcaacgtcaagcctcaggtcgacctgtggacctttggcgacacgggccgctcgatcatcgtgctgtccgaggggcggctgctgaacctgggcaatgccaccgggcacccctcgttcgtgatgagcaacagcttcgctaaccagacgatcgcccagatcgagctgtggaccaagaacgacgagtacgacaacgaggtgtaccggctgcccaagcacctcgacgagaaggtggctcgaatccatgtcgaggcccttggcggtcacctgaccaagctgaccaaggagcaggccgaatacctcggcgtcgacgtcgagggtccctacaagccggaccactaccgctactga

SEQ ID NO: 459 - DNA, 636 bp, Mycobacterium Tuberculosis
gtgagcactccaagcgctactgtcgcgcctgtgaagcggataccctatgccgaggcctcgcgggccctgttgcgggattcggtgctggatgcgatgcgggatctgctgctgacccgcgactggtccgccatcacgctgtccgacgtggcccgcgcggcgggcatcagccggcagaccatctacaacgaattcggttcccggcaaggcctggcgcagggatacgcgctgcgcctggccgaccgattagtggacaacgtccatgcatcgttggacgccaacgtcggcaacttttacgaagcgttcctgcagggctttcggtcgttcttcgccgagtcggcggcagatccgttggtcatctcgctgttgaccggtgtcgccaagcccgatctgctgcaactgatcaccaccgacagcgcgccgatcatcacccgcgcgtcggcccggctggcgccggccttcaccgatacctgggtggccaccaccgataacgacgccaatgtgctctcgcgtgcgatcgtgcggctgtgcttgagctacgtgtcgatgccgcccgaggccgaccatgatgtcgcagcggacctagcacggctaataacgccgttcgcggagcgtcacggtgtgatcaatgtcccctga

SEQ ID NO: 460 - DNA, 1251 bp, Mycobacterium Tuberculosis
atgaccacgcaaatcggctctggtggacccgaagccccccggccgcccgaagtcgaggagtggcgggacaagaagcgttacctgtggcttatgggcctcatcgccccgacggccttggtggtgatgctgccgctgatctgggggatgaaccagctcggctggcacgccgccgcgcaggtgccgctgtggatcggaccgatcctgctctacgtcttgttgccgcttcttgacctacgcttcgggcccgacgggcagaacccgcccgacgaggtgaccgaccggctggagaatgacaagtactaccgctactgcacctacatctacatcccgttccagtacctcagcgtggtgctgggcgcatacctgttcaccgccgcaaacctcagttggctcggctttgacggcgccttgagctgggcgggcaagcttggggtggcgctgtcggtcggtgtgcttggcggcgtcggtatcaacaccgcccacgaaatggggcacaagaaggattcgctggagcggtggctgtccaagatcaccctcgcccagacctgctacgggcacttctacatcgagcacaaccgtggccatcacgtccgggtgtccacaccggaggacccggcgtcggcgcggttcggcgagacgttgtgggagttcctgccccgcagtgttatcggcggcttgcgctcggccgttcatttggaggcccaacggctgcgtcggctcggcgtcagcccctggaatcccatgacgtatctgcgcaacgacgtgctcaacgcgtggctgatgtcggtggtgttgtggggtgggctgatcgcggtcttcggcccggcgctgatcccgttcgtcatcatccaggcagtcttcggcttcagcctgttagaggccgtcaactacctcgaacactacggactgctacggcagaagagcgccaacggccgctacgagcgctgcgccccggtgcacagctggaactccgaccacatcgtcaccaacctgttcctctaccacctgcagcgacacagcgatcaccacgccaaccccactcgccgctatcagacactgcggagcatggcgggtgcgcccaacctgcccagtgggtatgcatcgatgatctcgctgacctacttcccgccgttgtggcgcaaggtaatggatcaccgggtgctggagcactacggcggcgatatcactcgggttaacctgcacccgcgcgtgcgggagaaggcactcgcccgttacggagcctcggcatga

SEQ ID NO: 461 - DNA, 420 bp, Mycobacterium Tuberculosis
atgcgcgggccactgctgccgccgacagtcccggggtggcgcagccgggccgagcggttcgacatggcagtgctggaagcctacgaacccatcgagcgacgctggcaggagcgggtgtcgcagctggacatcgcggtcgacgagatcccgaggatcgcagccaaagatcccgaaagtgtgcagtggccgccggaagtcatcgccgacggaccgatcgcgctggcccggctcatcccggccggcgtggacgtccgcggaaatgcgacgcgcgcgcgaatcgtcttgtttcgcaaaccaattgaacgacgggccaaggacaccgaggaacttggtgaattgctgcacgaaatcctggtggcccaggtggccatctacctggacgtcgacccatccgtcatcgacccgacgatcgacgactag

SEQ ID NO: 462 - DNA, 1662 bp, Mycobacterium Tuberculosis
atgcaacctagtcatccgacgcgccctggtgcggtcatcagatatgtcggtagctcccttgatacttgtcccatgacgacgttcgccggcaaaacggctgcgtccgctgacaaggtgcgcgggggctactacacgccgccggcggtggcccgattccttgcccactgggttcaccaggcggggccgaagatcctcgaaccatcctgcggcgatggccgaatcctgcgcgaactctccgccatcacagaccacgcgcacggtgtggaactcgttgcgcgcgaggcgaaaaagtcgcgggacttcgcgtccgtcgacactgagaacctttttacctggctgcacaagacccaactcggcagctgggatggcgttgccggcaacccgccctacatccgcttcggaaactgggcatccgaacaacgggatccggcactcgaattgatgcggcgtgtgggcctacgaccgaccaaactgaccaatgcctgggtcccgtttgtcgtggcgagcacgacgctagcgcgtgacggcggccgagtgggcctggtggtcccggcggaattgcttcaagtcacctacgcggcgcagctacgcgaattcctgctgagccgctatcgggagatcaccctggttaccttcgagcggctggtgttcgacggaatcctgcaggaagttgtgctgttctgcggcgtcgtcggtcccggtcctgcacacatacgcaccgtcaggctcggcgatgcgaacgatctgaacgcgctgggggacaaggacttcaccaatgagtcagcgccggcgcttctccacgaaaaggagaagtggaccaagtacttcctcgaccccgctcaaatccggctactgcgaggactcaaacagtccgccactatgatcaggctcggcgaactggccgacgtggatgtgggcatcgtgaccggccgcaacagcttcttcacgttcaccgatgccaaggcacaagcgctgggattgcgagcgcactgcgttcccctggtctctcgcagcgcccaactcagcgggctgatctatgacgaggattgccgggcatgcgatgtcgccggcaaccaccgaacgtggctactcgacgccgcggactatccaaccgatccagctctcgtcgctcacatcaccgcgggtgaagcggccggcgtccacctcggctacaagtgctcgatccgcaagccatggtggagcacaccatcgctgtggatgcccgacctctttatgctgcgccagatccacttcgccccgcggctgaccgtcaacgctgccgcggcgaccagcaccgataccgtgcaccgggtccggctcgacccgaacgtcgatccggcaactcttgccgcggtgttccacaacagcgcgacattcgcgttcgccgagatcatgggccgcagttatgggggcggcatcttggagttggagcctagggaagccgagcaactacctatgccaccgccggcgtacgggagcgcagaacttgcccaggatgttgatctcctgctgaaagcaaacgagatcgacaaggcgctcgacgtcgtggaccgtcacgttctgatcgacgggctcggcttgtcgccgcgcctggtcgcaggttgccgagcggcatggctcacgctccgcgaccgcaggaccaagcgcggatctcggcgataa

SEQ ID NO: 463 - DNA, 1080 bp, Mycobacterium Tuberculosis
ttggcaactcaccaagtcgatgcggtggtcctggtcggtggcaagggtacccgactgcggccgttgacgctgtcggcgcccaagccaatgctgcctaccgccggactgccgttcctcacccatctgctgtcgcggatcgccgcagcgggcatcgagcacgtgatcctgggtacgtcctacaaacccgcagtcttcgaagcggagttcggcgacgggtccgcactgggcctacagatcgaatacgtgaccgaggagcatcccttggggactggcggcggcatcgccaacgttgccggcaagctgcgcaacgacaccgcgatggtgtttaacggcgatgtgctctcgggcgcggatctggcccaactgctggacttccaccgaagcaatcgagccgatgtcacgctgcaactggtgcgggtgggcgacccgcgggcattcggctgcgtacccaccgacgaggaggaccgcgtagtcgcctttctggagaagacggaggatccgccgaccgaccagatcaatgccggctgctatgtcttcgaacgcaacgtcatcgaccggattccgcagggccgggaggtttcggtggaacgcgaggtgttcccggccttgctcgccgacggcgactgcaagatctacggctatgtcgatgccagctattggcgggacatgggcacaccggaagacttcgttcgcggatcggcggatctggtgcgcggcatcgccccgtctccggccttgcgtggtcaccgcggtgagcagttggtgcacgacggtgcggcggtatctcccggtgcgttgctgattggcggcaccgtcgtggggcgtggtgccgaaatcggccccggcaccagattggacggcgcggtcatcttcgatggtgtccgggtggaggccgggtgcgtgatcgagcgttcgatcatcggcttcggtgctcgcatcggaccgcgggcgttgatccgcgacggtgtgatcggtgacggggccgacatcggcgcgcgctgcgagttgttaagtggtgcccgggtatggcccggtgtctttcttcccgacggcgggatccgttactcgtccgacgtttga

SEQ ID NO: 464 - DNA, 1185 bp, Mycobacterium Tuberculosis
atgccgaccagcaaccccgccaaaccacttgacgggtttcgggtattggatttcacccagaacgtggccgggccgctggccgggcaggtgctggtcgacctgggggctgaagtcatcaaggtggaggcgcccggcggtgaagcggcccgtcagatcacctcggtgttacccggacgcccgcccctggccacctactttctgcccaacaatcgtggcaagaagtcggtgacggtggacctaaccaccgagcaggccaagcagcagatgctgcggctcgcggacaccgccgacgttgtcttggaggcgtttcggcccggcaccatggaaaagctgggcctaggccctgatgacttgcgctctcgtaaccccaacctgatctacgcgcgcctaaccgcttacggcggcaacggcccgcacggcagccggccgggaatcgacctggtggtggccgccgaggccggcatgaccaccggaatgcccacgcctgagggcaagccacagatcatcccatttcagctcgtcgacaacgccagcggtcacgtgctggcccaggccgtgctggccgcgctgctgcaccgcgagcggaacggggtggccgacgtcgtccaggtcgcgatgtacgacgtcgcggtgggactacaagccaaccagctgatgatgcatctcaatcgggccgctagcgaccagccgaagcctgaaccggcaccgaaggccaagcggcgcaagggagtcggcttcgctacccagccatcggacgcgtttcgcaccgccgatgggtacatcgtcatcagcgcatatgtgcccaaacactggcagaagctgtgctacctcatcggccggcctgacctcgttgaagatcaacgatttgccgaacaacgctcccggtcgatcaactacgccgagttgaccgccgagttggaattggcactggccagcaagaccgccaccgaatgggtccagttgctgcaggcaaacggcctcatggcctgcctcgcccatacctggaaacaggtcgtcgacaccccccttttcgccgagaacgacctcaccctggaagtcggtcgcggggcggacaccatcacggtgatccgcacaccggcgcgctacgccagcttccgcgcggtcgtcaccgatcccccgcccaccgccggcgaacacaatgccgtgtttctggcccggccctga

SEQ ID NO: 465 - DNA, 1170 bp, Mycobacterium Tuberculosis
atggttggatgggccggaaacccgtcgttcgatctgttcaagctgcccgaggaacacgacgaaatgcgatcggcgatacgggctttggcggaaaaggagatcgctccgcatgccgccgaggtggacgagaaggcgcggttccccgaagaagcgctagtggcgctcaattcctccggtttcaacgccgtccacattccggaggagtacggcggtcagggtgccgactcggtagctacctgcatcgtgatcgaagaggtggcccgcgtcgacgcgtccgcgtcgttgatccccgcggtcaacaagctgggcaccatgggcctgatcctgcggggctccgaggagctgaagaagcaggtgctgccggcgttggccgccgaaggggcgatggcttcctatgcattgagtgaacgcgaggccggcagtgacgcggcgtccatgcggacgcgggccaaggccgatggggatcactggattctcaacggcgccaagtgctggatcaccaacggcggcaagtcgacctggtacacggtgatggcggtgaccgatcccgaccggggcgccaacggcatctcggcgttcatggtgcacaaggacgacgaggggttcaccgtcggtccgaaagaacgcaagctcgggatcaaggggtcaccgaccaccgagctgtacttcgagaactgccgcatccccggcgatcgcatcatcggtgagcccggtaccggtttcaagaccgcgctggccacgttggaccacacccgtcccacgattggcgcgcaggccgtgggtatcgcccagggcgcgctggatgctgccatcgcctacaccaaggaccgcaagcagttcggtgagtcgatcagtacgtttcaggccgtgcagttcatgctggccgacatggcgatgaaggtggaggcggctcggctgatggtttactccgccgccgcccgcgccgaacgcggtgagccggatctgggcttcatttcggcggcctcgaagtgcttcgcctccgacgtcgcgatggaggtcaccaccgatgccgtacaactgttcggcggcgccggctacaccaccgacttcccggtcgagcggtttatgcgcgacgccaagatcacccagatctatgagggcaccaatcagattcagcgggtagtgatgtcgcgggcgctactgcgctga

SEQ ID NO: 466 - DNA, 669 bp, Mycobacterium Tuberculosis
atgacccggctggtgctcgggtccgcctcccctggccggctcaaagtccttcgtgatgccggcattgagccgctggtcatcgcctcgcacgtcgacgaggatgtcgtcatcgcggcgctggggccggacgcggtcccgagcgatgtggtgtgcgtactggccgcggcaaaggccgcgcaggtcgcgaccacgctgaccggaacgcaacgcattgtggccgcggattgcgttgtcgttgcctgtgattcgatgctctacatcgaaggcaggctactcggcaagccagcgtcaatcgacgaggcgcgcgagcagtggcggtcgatggcgggccgggccggccaactctatacgggccacggtgttatccggttgcaggacaacaaaaccgtgtaccgtgctgctgaaacagcaataaccacagtatatttcggaacaccttcggcctccgatctggaggcttacctggccagtggggagtcgctgcgggtcgcgggtggattcaccctggacggtctgggcggctggttcatcgacggcgtgcagggcaatccgtcgaatgtgatcggcttgagcctgccgttgctgcggtcgctcgtgcagcgatgcgggctgtccgtcgccgcactgtgggcaggaaatgcgggcggcccagcgcacaagcagcagtag

SEQ ID NO: 467 - DNA, 1803 bp, Mycobacterium Tuberculosis
gtggctagtcacgccggctcgaggatcgctcggatctctaaggttctcgtcgccaatcgcggcgagatcgcagtgcgggtgatccgggcggcccgcgacgccggcctgcccagcgtggcggtgtacgccgaacccgacgccgagtccccgcatgttcggctggccgacgaggcgttcgcgctgggcggccagacctcggcggagtcctatctggacttcgccaagatcctcgacgcggcagccaagtccggggccaacgccatccaccccggctacggcttcctagcggaaaatgccgacttcgcccaggcggtgatcgacgccggcctgatctggatcggccccagcccgcagtcgatccgcgacctgggcgacaaggtcacggcccgtcacatcgcggcccgcgctcaggcgcccctggtgccgggtacccccgatccggtcaaaggcgccgacgaggtggtggcattcgccgaggagtacggcctgccgatcgcgatcaaggccgcccacggcggcggcggcaagggcatgaaggtggcccgcaccatcgacgagattccggagctgtacgagtcggcggtgcgcgaggccacggccgcgttcggccgcggtgagtgctacgtggagcgctatctcgacaagccgcgccacgtcgaagcacaggtgatcgccgaccagcacggcaacgtcgtcgtcgccggcacccgggactgctcgctgcagcgccgctaccagaagctggtcgaggaggcgcccgcaccgttcctgaccgactttcaacgcaaagagatccacgactcggccaaacggatttgcaaagaggcccattaccacggcgccggcaccgtcgaatacctggtcggtcaggacggcttgatctcgttcttggaggtcaacacgcgccttcaggtagaacacccggtcaccgaggaaaccgcgggcatcgacttggtgctgcagcaattccggatcgccaacggcgaaaagctggacatcaccgaggatcccaccccgcgcgggcacgccatcgaattccggatcaacggcgaggacgcggggcgtaacttcctaccggcgcccgggccggtgacaaagttccacccgccgtccggccccggtgtgcgggtggactccggtgtcgagaccggctcggtgatcggcggccagttcgactcgatgctggccaagctgatcgtgcacggtgccgaccgcgccgaggcgctggcgcgggcccggcgcgcgctgaacgagttcggtgtcgaaggcctggcgacggtcatcccgtttcaccgcgccgtggtgtccgacccggcattcatcggcgacgcgaacggcttttcggtacatacccgctggatcgagaccgagtggaataacaccatcgagccctttaccgacggcgaacctctcgacgaggacgcccggccgcgtcagaaggtggtcgtcgaaatcgacggtcgccgcgtcgaagtctcgctgccggctgatctcgcgctgtccaatggcggcggttgcgacccggtcggtgtcatccggcgcaagcccaagccgcgcaagcggggtgcgcacaccggcgcggcggcctccggtgacgcggtgaccgcgcctatgcagggcaccgtagttaagttcgcggtcgaagaagggcaagaggtcgtggccggcgacctagtggtggtcctcgaggcgatgaagatggaaaacccggtcaccgcgcataaggatggcaccatcaccgggctggcggtcgaggcgggcgcggccatcacccagggcacggtgctcgccgagatcaagtaa

SEQ ID NO: 468 - DNA, 1284 bp, Mycobacterium Tuberculosis
gtgaccgacttcgcattcgacgccccgaccgtcatccgcaccaaacgtgacggcggccggttgtccgacgccgccatcgactgggtcgtcaaggcctataccgacggccgggtcgccgacgaacagatgtcggcgctgctgatggcgatcgtttggcggggcatggaccgcggcgagatcgccagatggacggcggccatgctggcctcgggtgcccggctggatttcaccgatctgccactagcgaccgtggacaagcattccaccggcggggtaggtgacaaaatcacgctgccattggtgcccgtcgtcgccgcctgcggtggcgcagtgccccaggcgtcgggccgcggactcggccacaccggcggcaccctggacaagctggaatccatcaccgggttcaccgcgaatctgtccaaccagcgggtgcgcgagcagctttgcgacgtcggcgccgcgatcttcgccgccggccagctggcgccagccgatgccaagctgtatgcgctgcgcgacattaccggcaccgtcgaatcgctgccgttgatcgccagttcgattatgagcaagaagctggctgagggtgcgggtgcactggtgctcgacgtcaaggttggttccggggccttcatgaggtcgccagtgcaggcgcgcgaacttgcgcacaccatggtcgaactgggcgcggcgcatggcgtgcccacccgtgccctgctgacggagatgaactgcccgctgggtcgaaccgtcggcaatgcgctcgaggtggccgaggcgctggaggtgctggccggcggcggaccgcccgacgtggtggagctgacgttgcggctggccggcgagatgctcgagcttgccgggatccacggccgggacccggcccagacgctgcgggacggcaccgcaatggaccggtttcgccggttggttgccgcgcagggaggtgacttgtcgaaaccgttgccgatcggttcgcattcggaaaccgtcacggcgggcgcgagcggcacaatgggcgacatcgatgcgatggcagtggggttagcggcatggcgactcggtgcgggcaggtcccgcccgggcgcacgcgtacagcacggtgcgggggtgcggattcatcgccgcccgggggagccggttgtggtcggtgagccgttgttcaccctctacacgaatgctcccgagcgctttggtgcggcgcgagccgagctggccggcggttggagtatccgggacagtccgccgcaggtgcggccgctaatcgtcgatcggatcgtctga

SEQ ID NO: 469 - DNA, 402 bp, Mycobacterium Tuberculosis
atgcctgatgtcgattggaatatgctgcggggcaatgcaacccaggcagcagccggagcctatgtgccgtattcgcggtttgcggtgggtgcggccgcactggtcgacgatggtcgcgtggtgaccggatgcaacgtggaaaacgtctcgtatggcttgactttgtgcgccgaatgtgcggtggtgtgcgccctgcattcgaccggcggcggccggctgctcgcgctggcctgcgtcgacggccatggatccgtgctgatgccgtgcgggcgatgccgtcaggtgctgctcgaacacgggggttccgagctactgatcgaccatccggtgcgaccccgccggctcggcgacctgctgcccgacgccttcggcctcgacgacctcccccgggaacgccggtga

SEQ ID NO: 470 - DNA, 666 bp, Mycobacterium Tuberculosis
atgattactgtcaatgtgctctactttggcgcggttcgcgaagcgtgcaaggtcgctcacgagaagatctcactcgaaagcggcaccaccgtcgacggcttagtcgaccaattgcaaatcgactatccgccacttgctgattttcgcaagcgagtgcggatggccgttaacgaatccatagcgccagcatcaacgattctcgacgatggcgacacggtggcgttcataccgcaggttgccgggggctccgatgtctactgccggctcaccgatgagccgctgagcgtcgatgaagtgctcaacgcgatatctggaccttcccagggcggcgccgtcatcttcgtgggtaccgtgcgtaacaacaacaacggccacgaagtgaccaagttgtactacgaggcctatccggccatggtgcaccgcacgctgatggacatcatcgaagagtgtgaacgacaggccgacggtgtgcgagttgccgtggcacaccggaccggtgaattgcgcatcggtgatgcggcggttgtcatcggtgcttcggctcctcaccgcgcggccgcgttcgacgccgctcgcatgtgcatcgagcggctcaaacaggatgtgccgatatggaagaaggagttcgcactcgacggtgttgagtgggtggccaatcggccatga

SEQ ID NO: 471 - DNA, 1011 bp, Mycobacterium Tuberculosis
atgagcacccctaccgggtcccgccggatcttctccggcgtgcagcccacgtctgactcgcttcacctcggtaatgccttgggcgccgtcgcccaatgggttggcttgcaggatgaccacgatgcgttcttctgcgtggtcgacctgcatgcgatcaccatccctcaggatcccgaggcactgcggcgccggaccctgattaccgccgcgcaatacctggcgttgggaatcgatcccggccgcgccaccatcttcgtgcaaagtcaggtgccggctcacacccagctggcgtgggtgctgggttgtttcaccggctttggccaggcgtcgcggatgacccagttcaaagacaagtcggcgcgtcagggcagcgaggccaccaccgtcggcctgttcacctacccggtactgcaggccgcggacgtgttggcctacgacaccgagctggtgcccgtcggggaggatcagcggcagcacctcgagctggcccgcgacgtcgcgcaacggttcaacagccgattccccggcaccctggtggttcccgacgtgctcatccccaagatgaccgccaaaatctacgatctacaagacccgacgtcaaagatgagcaaatcggcgggcaccgatgccggtttgatcaacctgctcgacgatccggcattgtccgccaagaagattcgctccgccgtgaccgacagcgaacgtgacatccgctatgacccggacgtcaagccaggggtgtctaacctgttgaacatccagtcggcggtcaccgggaccgacatcgacgttctcgtcgacggctatgccggacacggctacggcgatttgaagaaagacaccgccgaggccgtcgtcgaattcgtcaacccgatccaagccagagttgacgaattgaccgcagatcccgcggagctggaggccgtgctcgccgccggggcgcagcgcgcccacgatgtggccagcaaaacggttcagcgagtctacgatcggctcgggttccttctataa

SEQ ID NO: 472 - DNA, 4617 bp, Mycobacterium Tuberculosis
atggtcatgtcgctgatggtggcgccggagctggtggcggcggccgcggcggacttgaccgggattgggcaggccatcagcgcggcgaatgcggcggcagcgggcccgacgacgcaggtgttggcggccgccggtgatgaggtgtcggcggcgatcgcggcgttgtttggtacccacgcgcaggagtaccaggcgttgagcgcccgggtggcgacgtttcatgagcagtttgtgcgctcgctgaccgcggctggcagcgcgtatgcgactgccgaggcggcgaatgcatcaccgctgcaggcgctggagcagcaagtgttgggtgcgatcaacgcgcccacacagctgtggttggggcgcccgctgatcggtgatggcgttcacggggcgccggggaccgggcagcccggtggggccggggggttgttgtggggtaatggcggtaacggcggttcgggggcggccggtcaagtcggtgggcccggcggcgcggccgggttgttcggcaacggcgggtccggcgggtccggcggggccggcgctgccggcggtgtcggcggatccggcgggtggttgaacggcaacggcggggccggcggggccggcgggaccggcgctaacggtggtgccggcggcaacgcctggttgttcggggccggcgggtccggcggcgccggcaccaatggtggcgtcggcgggtccggcggatttgtctacggcaacggcggcgccggcgggatcggcggcatcggaggtataggcggcaacggtggcgacgccgggctgttcgggaacggcggcgccgggggggccggggccgcgggcctgccgggtgccgccggcctcaacggcggcgacggcagcgacggcggcaacggcggaaccggcggcaacggcgggcgcggcgggttattggttggcaacggcggggccggcggggccggcggcgtcggcggcgacggtggtaagggcggcgctggcgatccgagtttcgccgtcaacaacggtgccggcggtaacggcggtcacggcggcaaccccggcgtgggcggggccggtggggccggcggcctgctggcgggtgcgcacggtgccgccggcgccacccccaccagcggcggcaacggcggcgatggcggcatcggcgccaccgccaactcacccctacaagccggcggggccggcggtaatggcggtcatggcgggttggtcggcaacggcggcaccggcggcgccggcggtgccggtcatgcgggttccaccggcgctaccggtaccgccttacaaccgacgggcggtaacggcaccaatggcggcgccgggggccacggcggtaatggcggaaatggcggcgcccagcacggcgacggcggcgtcggcggcaagggcggtgccggcggtagcggcggcgccggcggaaacggattcgacgccgccaccttgggttcgcccggtgccgatggcggtatgggcggcaacggcggcaagggcggtgacggcggcaaggccggtgatggcggagccggtgccgccggtgatgtgaccttggccgtcaaccagggtgccggcggtgacggcggcaacggcggtgaagtgggcgttggcggcaagggtggggccggcggtgttagcgcgaacccggccctgaacggttcggccggggcgaacggcaccgcgcccaccagcggcggcaacggtggcaacggaggtgccggcgccacccccaccgtcgcgggagaaaacggcggcgccggtggtaacggcggccatggcgggtcggtcggtaacggcggtgcgggtggtgccggcggaaatggcgtcgccggcaccggccttgccctcaacggcggcaacggcggcaacggcggcatcggcggcaacggcggatcggcggccggcacgggcggggacggcggcaagggcggcaacgggggcgccggagccaacggccaagacttctccgcgtccgccaatggcgcgaatggcggacagggcggcaacggcggcaacggcggcatcggcggcaagggtggtgacgccttcgccacgttcgctaaggccggcaacggcggtgccggcggcaacggcggcaatgtgggcgttgccggccagggtggggccggcggcaagggcgccattccagccatgaagggtgcgaccggcgccgatggcaccgcacccaccagcggcggtgacggcggcaacggcggcaacggcgccagccccaccgtcgcgggcggcaacggcggtgacggcggcaagggcggcagcggcgggaatgtcggcaatggcggcaatggcggggccggcggcaacggcgcggccggccaagccggtacgccgggccctaccagcggtgattccggcacctcgggcaccgacggtggggctggcggcaacggcggggcgggcggcgccggcggaacactggccggccacggcggcaacggtggtaagggtggtaacggcggccagggtggcatcggcggcgccggcgagagaggcgccgacggcgccggccccaatgctaacggcgcaaacggcgagaacggcggtagcggtggtaacggtggcgacggcggcgccggcggcaatggcggcgcgggcggcaaggcgcaggcggccgggtacaccgacggcgccacgggcaccggcggcgacggcggcaacggcggcgatggcggcaaagccggtgacggcggggccggcgaaaacggcctaaacagcggggccatgctgccgggcggcggcaccgtaggaaaccccggtaccggcggcaacggcggcaacggcggcaacgccggcgtcggcggcaccggaggcaaggccggcaccggctccttgacgggcttggacggcaccgacggcatcacccccaacggcggtaacggcggcaatggcggcaacggcggcaagggcggcaccgccggcaacgggagcggcgcggccggcggcaacggcggcaacggcggctccggcctcaacggcggtgacgccggcaacggcggcaacggcggtggggcgctgaaccaggccggcttcttcggcacgggcggcaaaggcggtaacggcggcaatggcggtgccggcatgatcaacggcggcctcggcggcttcggcggcgccggcggtggcggcgccgttgacgtcgccgcgacaacgggcggcgctggcggcaatggcggtgccggcggcttcgctagcaccgggttgggtggcccaggcggcgccggcggtcccggcggcgcgggcgactttgctagcggtgttggcggtgtcggcggcgccggcggggacggcggtgccggcggggtcggcggcttcggcggccagggcggcatcggcggggaagggcgcacaggcggcaacggcggtagcggcggcgacggcggtggcggcatttccttaggcggcaacggcggcctcggcggcaacggcggcgtctccgagactgggtttggcggcgccggcggcaacggcggctacggcggtccgggaggccccgaaggcaatggcggcctcggcggcaacggcggcgccggcggcaacggcggcgtcagcaccacgggcggcgacggcggcgccggcggcaagggcggcaacggcggcgacggcgggaacgtcggtttgggcggtgacgccggctccggcggcgcgggcggcaatggcggtatcggcaccgacgcgggcggtgccggaggggccggtggcgctggcggtaacggcggtagcagcaaaagcacgaccaccggcaacgccggctccggtggtgccggcggtaatgggggcactggcctcaacggcgcgggcggtgctggcggggccggcggcaacgcgggtgtcgccggcgtgtccttcggcaacgctgtgggcggcgacggcggcaacggcggcaacggcggccacggcggcgacggcacgacgggcggcgccggcggcaagggcggcaacggcagcagcggtgccgccagcggctcaggcgtcgtcaacgtcaccgccggccacggcggcaacggcggcaatggcggcaacggcggcaacggctccgcgggcgccggcggccagggcggtgccggcggcagcgccggcaacggcggccacggcggcggtgccaccggcggcgacggcggcaacggcggcaacggcggcaactccggcaacagcaccggcgtcgcgggcttggccggtggtgccgccggcgccggcggcaacggcggcggcacttccagcgccgccggccacggcggcagcggcggcagcggtggcagcggcaccacgggcggcgccggcgcggccggcggcaacggcggcgccggtgctggcgggggcagcctgagcacaggccagtccggcggcccacggcggcagcggtggtgccggtggcaacggcggcgctggctcggccggcaacggcggcgccggtggtgccggtggcaacggcggtgccggcggcaacggtggcggtggcgatgccggcaacgccggctcaggcggcaatggcggcaagggcggcgacggtgtcggccctggctccaccggcggcgcgggcggcaagggcggcgctggcgccaacggcggttccagcaacggcaacgctcgcggtggcaacgccggtaa

SEQ ID NO: 473 - DNA, 9474 bp, Mycobacterium Tuberculosis
ttgaattttccagttctgccaccggaaatcaactccgtgctgatgtattcgggtgcggggtcgagcccgttgctggcggcggccgcggcgtgggatgggctggctgaggagttggggtcggcggcggtgtcgtttgggcaggtgacgtcgggcctgacggcgggggtgtggcagggtgcggcggcggcggcgatggcggccgcggcggccccgtatgcggggtggttgggttcggtggcggcgcaggccgtggcggtggccgggcaggcgcgggccgcggtggcggcgtttgaggcggcgttggcggcgacggtggatccggcggcggtggcggtcaaccggatggcgatgcgggcgttggcgatgtcgaacctgctggggcagaacgccgcagcgatcgcggccgtcgaggccgagtacgagttgatgtgggccgccgatgtggcggcgatggccggctaccattccggcgcgtcggctgctgccgcggcgttgccggcgttcagcccaccggcgcaggcgttggggggtggtgtcggcgcgttcctcaatgctctatttgccggacccgcgaagatgttgaggcttaacgcgggcttgggcaatgtcggtaattacaacgtcgggttgggcaatgtcgggatattcaacctgggcgcagccaatgtcggtgcgcagaatttgggtgctgccaacgccggtagcgggaatttcggtttcggcaatatcggcaacgccaacttcgggttcggcaactcgggtcttgggttgccgccgggcatgggcaatattgggttgggcaatgcgggcagcagcaactacggcctcgcaaacctgggtgtgggcaacatcggttttgccaacacgggtagcaacaacatcgggatcgggttgaccggggacaacctgactggcattgggggcctgaattcaggaaccggtaatctggggttgttcaactccggcaccggcaacattgggttcttcaattcggggaccggcaacttcggggtattcaactcgggcagctacaacaccggtgtcggtaatgcggggacggccagtaccgggttgttcaacgttggtgggttcaacacgggtgtggccaacgtgggtagctataacacgggcagcttcaacgcgggcaacaccaatacgggtggcttcaacccgggcaacgtcaacaccggctggctgaacaccggcaacaccaacaccggcatcgccaactcgggcaatgtcaacaccggcgcgttcatctcgggcaacttcagcaacggtgtgctgtggcggggtgactacgagggcctgtgggggctctccggtggatcgaccattccggcgatccccattggtctcgagctcaacggcggcgtcggccccatcaccgtgttgccgatccagattttgcccaccatcccgctcaacattcaccaaaccttcagcctcggcccgctggtcgttccggacatcgtgatccccgcttttggtggcggtacggccatacctatcagcgtcggccccatcaccatctcgcccatcaccctgttcccggctcagaacttcaacacgactttccccgtcggccccttctttggcttgggggtcgtcaacatttcaggaatcgaaatcaaagatcttgccggcaacgtcaccctccaattaggtaaccttaatatcgacaccagaattaaccagtcattcccggtgaccgtcaactggagtaccccggcagtaacgatcttcccgaatggcatcagtattcccaacaatccactggcgctgctggccagcgcgtcgatcggcacgctgggattcacgatcccgggcttcaccattcccgctgcgccgctgccgctgacgatcgacatagacggccagattgacggcttcagcaccccgccgatcacgatcgaccgcatcccgctgaacctcggcgccagcgtcactgtcggccctatcctgatcaacggcgttaatatcccggcgaccccgggctttggcaacacgaccaccgctccgtcgtcgggtttcttcaactccggcgacggtggggtgtcgggcttcgggaatttcggtgcgggcagctcgggttggtggaaccaggcgcagaccgaggtggctggggcgggttcgggtttcgccaatttcggttcgctgggatcgggtgtgctgaacttcggctcgggtgtgtcggggctgtacaacaccggcgggttgccgccggggaccccggcggtggtctcgggcatcggcaatgttggtgagcagctgtcggggttgtcctcggcggggacggcactcaaccagagcctcatcatcaatctcgggttggccgatgtgggcagcgtaaacgtcggtttcggcaacgtcggggacttcaacctgggtgcggccaatatcggcgacttgaacgtgggtttgggcaatgtcggcggcggcaacgtcgggttcggcaatatcggcgatgccaacttcgggttgggcaatgcgggtctggcggcgggcctggccggggtgggcaacatcgggttgggcaatgccggcagcggcaacgtcggcttcggcaacatgggtgtgggcaacatcgggttcggtaacaccggcaccaacaacctcgggattgggctgaccggggacaaccagactgggatcggcggcttgaactccggtgccggcaacatcgggttgttcaactccggcaccggcaacgtcgggttgttcaactccgggaccgggaacttcgggttgttcaactcgggcagcttcaacaccggcatcggcaatggcggaacgggcagtactgggcttttcaatgccggtaatttcaataccggtgtggccaaccctgggtcgtacaacacgggcagcttcaatgtgggtgacaccaacaccggtggtttcaacccgggcagcatcaacaccggctggttcaacaccggcaacgccaacaccggcgtcgccaattcgggcaatgtcgacaccggcgccctcatgtcgggcaacttcagcaacggcatcttgtggcgaggcaacttcgagggcctgttcggcctgaacgtcggcatcacgattcccgaattcccgatccactggacttcaaccggcggcatcggccccattatcatcccggacaccacgatccttccccccatccacctgggcctcacgggacaagcgaactacggcttcgccgtgccggacatccccattccggcaatccacatcgacttcgacggtgccgccgacgccggcttcaccgccccggccaccaccctgctttctgcgctgggcattaccggacaattcaggttcggcccgatcaccgtctcaaacgtccagctcaatccgttcaacgttaacctcaagcttcagttcctccacgacgcgttcccaaatgaatttcccgatcccacaatctcggttcagatacaggtcgccataccccttacttcggcaacgctgggcggattggccctgccgctgcagcagaccatcgacgccatcgaattgccggcaatctcgttcagccaatccatacccatcgacattccgccgatcgacatcccggcctccactatcaacggaatttcgatgtcggaggtcgtgccgatcgatgtgtccgtcgacattccggcggtcaccatcaccggcaccaggatcgacccgattccgctgaacttcgacgttctcagcagcgccggacccatcaacatctcgatcatcgacattccggcgctgccgggctttggcaactcgaccgagctgccgtcgtcgggcttcttcaacaccggcggcggtggcggctcgggcatcgccaacttcggcgcgggggtgtccggcttgctgaaccaggcctcgagtccgatggtggggacgctctccggcctgggcaatgccggcagcctggcatccggtgtgctgaactccggcgtcgacatctcgggcatgttcaacgtgagcacgctgggctccgcgccggcggtgatctcgggtttcggcaacctgggcaaccacgtgtcgggggtgtccatcgatggcctgctggcgatgctgaccagcggcgggtcgggcggctccgggcagccgagcatcatcgacgcggcgatcgccgagctgcggcacctgaatccgctgaacatcgtcaacctgggcaacgtcggcagctacaacctcggcttcgccaacgtcggcgacgtcaacctgggcgcgggcaacctcggcaacctcaacctcggcggtggcaacctcggcgggcagaacctggggttgggcaacctcggggacggcaacgtcgggttcggcaacctcggccacggcaatgtcgggttcggcaactcgggcctgggggcgctgccggggatcggcaacatcgggttgggcaacgccggcagcaacaacgtcggcttcggcaacatgggcctgggcaacatcgggttcggcaataccggcaccaacaacctcgggatcgggctgaccggcgacaaccagaccgggttcggcggcctgaactccggtgccggcaacctggggttgttcaactccggcaccggcaacatcgggttcttcaacaccgggaccggaaactgggggttgttcaactcgggcagctacaacaccggcatcggtaacagcggaacgggcagtaccgggcttttcaatgccgggagtttcaacacgggtctggccaatgccggtagttacaacaccggcagcctcaacgcgggcaacaccaacaccggcggcttcaaccctggcaatgtcaacaccggctggttcaacgccggccacaccaacaccggcggcttcaacacgggcaatgtcaacaccggcgcgttcaactccggcagcttcaacaacggcgcgctgtggaccggtgatcaccacgggctggtcggcttctcctacagcatcgaaatcaccggcagcaccctggtggacatcaacgaaaccctcaacctcggtcccgtccacatcgatcagatcgatattcccggcatgtcgctgttcgacatccacgaactcgtcaacatcgggcccttcaggatcgagcccatcgatgtccccgcagtggtgctggacatccacgaaacgatggtcatcccgcccatcgtcttcctgccgagcatgacgatcggcggtcagacctacacgattccgctcgacacgcccccggcccccgccccgccgcccttcagacttccgttgctgttcgtgaatgcgctcggcgacaactggatcgttggggcgtccaactcaaccggaatgagtggtggctttgtcaccgcacccactcagggcatcctgatccataccggtcccagcagcgcaaccaccggtagcctcgcactaaccctcccaaccgtcaccatcccaacgatcacgacatcgcctatcccgctcaagatcgatgtgtcgggcggtcttccggccttcacgctgttccccggtggcctcaacatcccgcaaaatgcgatcccgttgaccatcgatgcgtccggcgtgctggatccgatcacgatattcccgggtggtttcacgatcgatccgctgccactgagcctggccctcaacatcagcgtgccggacagcagcgttccgatcatcatcgttccgccgacgcccggcttcgggaacgcgaccgccaccccgtcgtcgggtttcttcaactccggcgcgggcggggtgtcgggtttcggcaacttcggggccggcagctcaggctggtggaaccaggcgcatgccgcgttggcgggcgcgggctcgggcgttctcaacgttggcacgctgaactcgggtgtgctgaacgtcggctcggggatatcggggctgtacaacaccgctatcgtgggtttggggacgccggcgctggtgtcgggtgccggcaacgtgggccagcagctgtcgggggtgttggcggccgggacggcgttgacccaaagccccatcatcaacctcgggttggccgatgtcggcaactacaacctcgggttgggcaacgttggggacttcaacctgggcgcggccaacctcggcgacctcaacctagggttgggcaatatcgggaacgccaacgtcggcttcggcaatatcggccacggcaacgtcgggtttggcaattcgggcctgggggcggcgctcggcatcggcaatatcgggttgggcaatgcgggcagcaccaacgttggcctggccaacatgggtgtgggcaacatcgggttcgccaacaccggcaccaacaacctcgggattgggctgaccggcgacaaccagaccggcatcggcggcttgaactccggtgccggcaacattggcctgttcaactccggcaccggcaacatcgggttcttcaactccgggaccggaaactgggggttgttcaactcgggcagcttcaacaccggcatcggtaatagcggaacgggcagtactgggcttttcaatgccggtggtttcactacgggtctggccaacgccgggtcgtacaacacgggcagcttcaatgtcggtgacaccaacaccggtggcttcaacccgggcagcatcaacaccggctggttcaacaccggtaacgccaacaccggcatcgcgaactcgggcaatgtcgacaccggcgccctcatgtcgggcaacttcagcaacggcatcctgtggcggggcaactacgaaggcctattcagctattcctacagcctcgacgttccccggatcaccatcctggacgcgcatttcaccggggccttcggcccggtggtcgtcccgcccatcccggttctggcgatcaacgcgcacctgaccggcaacgcggcgatgggcgccttcaccatcccgcaaatcgatattcccgccctcaatccgaacgtcaccggaagcgtcggcttcggccccatcgcggtcccctcggtcaccattcccgccctgaccgccgcacgagcggtcctcgatatggccgcgtcggtcggggcgaccagcgaaatagagccgtttatcgtctggacgtcatccggtgcgatcggcccaacgtggtactcggtcggcagaatctacaacgccggtgacctgttcgtcggcggcaatatcatctcgggaatcccgacgctcagcacgaccggcccggtgcatgccgtcttcaatgcggcatctcaggcgttcaacaccccggcgctcaatattcaccagatcccgttgggtttccaggtgccgggcagcatcgacgcgatcaccctgttccccggtggtctgacgttcccggcgaactcgctgctgaacctggatgtgttcgtcggcacccccggcgccaccattccggcgatcacgttcccggagatcccggcgaacgccgacggcgaactctacgtcatcgccggcgacatcccgctgatcaacatcccgcccaccccgggcattgggaacaccaccaccgttccgtcgtcgggcttcttcaacaccggggcgggcgggggctcgggtttcggcaacttcggcgcgaacatgtcggggtggtggaaccaggcgcacaccgctttggcaggcgcgggttcgggtattgccaacgtcggcacactgcactccggcgtgctcaacctcggttcggggctgtcggggatctacaacaccagcacgctgccgcttgggacgccggcgttggtgtcgggcctgggcaacgtcggtgatcacctgtcgggcttgttggcctccaacgtggggcaaaaccccatcaccatcgtcaacatcgggttggctaacgtcggcaacggcaacgtcggcctcggcaacatcggcaacctcaacctgggtgcggccaacattggcgacgtgaacctgggattcggcaacattggcgacgtgaacctgggcttcggcaacatcggcggcggcaacgtcgggttcggcaatatcggcgatgccaacttcgggttcgggaattcgggtctggcggcgggcctggccggcatgggcaatatcgggctgggcaacgccggcagcggcaacgtcggctgggccaacatgggcctgggcaacatcgggtttggcaacaccggcaccaacaacctcgggatcgggctcaccggcgacaaccagtccggcatcggcggcttgaactccggcactggcaacattggcctgttcaactccggcacaggcaatatcggcttcttcaactccgggactgccaacttcgggttgttcaactccggcagctacaacaccggtatcggcaactccggggtggccagcaccgggttggtcaacgccggcggcttcaacaccggtgtggcaaacgccgggtcgtacaacacgggcagcttcaatgctggtgacaccaacaccggtggcttcaacccaggcagcaccaacaccggctggttcaacaccggtaacgccaacaccggcgtcgccaacgcgggcaatgtcaacaccggcgccctcatcacgggcaactttagcaacggcatcttatggcggggcaattacgagggcttggccggcttctccttcgggtaccccattccgctgttccccgcggtgggcgccgacgtcaccggcgacatcggccccgccaccatcattccgcccatccacatcccgtccatcccgttgggcttcgccgcgatcggccacatcgggccgatcagcatcccgaacatcgccatcccctcgatccacctgggcatcgatcccaccttcgacgtcggccctatcaccgtggaccccatcaccctcaccatccctggcctaagtttggatgctgccgtctcggagatcaggatgacgtccggaagcagctccggattcaaggtcagacccagcttttcattcttcgcggtcggacccgacggcatgcccgggggcgaggtctccatacttcaaccattcaccgtggcacccatcaacttgaacccgacgacactgcacttccccggattcaccattcccaccggacccatccacatcggcctgccgctgtcgctgaccattccgggcttcaccatcccgggcggcaccctgattccccaactcccgctgggcctcggtttgtccggcggcaccccaccctttgatctcccgacggtcgttatcgaccggatcccggtggagttacacgccagcaccaccatcggccccgtcagcctcccgattttcgggttcggcggagcaccgggctttggcaacgacaccaccgcgccgtcgtcgggcttcttcaacaccggcggtggtggcgggtccggcttctccaactccgggtcgggcatgtcgggggtgctcaacgcgatctcggatccgctgctcgggtcggcgtcgggcttcgccaatttcggcacccagctctccggcatcctcaaccgtggcgcgggcatctcgggcgtgtacaacacgggcacgcttggcctggtcacatcggccttcgtctcgggctttatgaacgtcggccagcagctgtcgggcctgctgttcgcgggcaccgggccgtaa

SEQ ID NO: 474 - DNA, 11151 bp, Mycobacterium Tuberculosis
atggagtttccggtgttgccaccggaaatcaactccgtgctgatgtattcgggtgcggggtcgagcccgttgctggcggcggccgcggcgtgggatgggctggctgaggagttggggtcggcggcggtgtcgtttgggcaggtgacgtcgggcctgacggcgggggtgtggcagggtgcggcggcggcggcgatggcggccgcggcggcgccgtatgcggggtggttgggttcggtggcggccgcggccgaggcggtggccgggcaggcgcgggtggtggtgggggtctttgaggcggcgttggcggcgacggtggatccggcgctggtggcggccaaccgggcgcggctggtggcgttggcggtgtcgaatctgttggggcagaacacgccggcgatcgcggccgccgaggccgagtacgagctgatgtgggccgccgatgtggcggcgatggccggctaccattccggcgcgtcggctgctgccgcggcgttgccggcgttcagcccaccggcgcaggcgctggggggaggtgtcggcgcgttccttaccgccctgttcgccagccctgcgaaggcgctgagcctgaatgcgggtttgggcaatgtcggcaattacaacgtcgggttgggcaatgtcggggtgttcaacctgggcgcgggcaatgtgggtgggcagaatctgggtttcgggaatgccggtggcaccaatgtcgggttcggcaacctcggtaacgggaatgtcgggttcggcaactccggtctgggggcgggcctggccggcttgggcaatatcgggttgggcaatgcgggcagcagcaactatggtttcgcaaacctgggtgtgggcaacatcggtttcggcaacaccggcaccaacaacgtcggcgtcgggctcaccggcaaccacctgacgggtatcgggggcctgaattcgggcaccgggaatatcgggttgttcaactccggcaccgggaatgtggggttcttcaattcggggaccgggaacttcggggtgttcaactcgggtaattacaacaccggtgtcggtaatgcggggacggccagcacggggttgttcaatgccggcaatttcaacaccggcgtggtgaacgtgggcagttacaacaccggcagtttcaacgccggcgacaccaacaccggtggcttcaaccccggcggtgtgaacaccggctggctgaacaccggcaacaccaacaccggcatcgccaactcgggcaacgtcaacaccggcgcgttcatctcgggcaacttcaacaacggcgtgctgtgggtgggtgactaccagggcctgttcggcgtctccgccggctcgtcgatccccgcaattcccatcggcctggtgctcaacggcgacatcggcccgatcaccatccagcccatcccgatcctgcccaccatcccgctcagcattcaccaaaccgtcaacttgggcccgctggtggttcccgacatcgtgatccccgccttcggcggcggtatcggcatacccatcaacatcggcccgctgaccatcacacccatcaccctgtttgcccaacagacatttgtcaaccaattgccctttcccaccttcagtttagggaaaatcacaattccacaaatccaaacctttgattctaacggtcagcttgtcagctttatcggccctatcgttatcgacaccaccattcccggacccaccaatccacagattgatttaacgatcagatgggatacccctccgatcacgctgttcccgaatggcatcagtgctcccgataatcctttggggttgctggtgagtgtgtcgatcagtaacccgggctttaccatcccgggatttagtgttcccgcgcagccgttgccgttgtcgatcgatatcgagggccagatcgacgggttcagcaccccgccgatcacgatcgatcgcatccccctgaccgtggggggcggggtcacgatcggccccatcacgatccagggccttcatatcccggcggcgccgggagtggggaacaccaccacggccccgtcgtcgggattcttcaactccggtgcgggtggggtgtcgggtttcggcaacgtcggcgcgggcagctcgggctggtggaaccaggcgccgagcgcgctgttgggggccggttcgggtgttggcaacgtgggcaccctgggctcgggtgtgctcaacctgggctcagggatctcggggttctacaacaccagcgtgttgcctttcgggacaccggcggcggtgtcgggcatcggcaacctgggccagcagctgtcgggggtgtcggcggcgggaaccacgctgcgctcgatgctcgccggcaacctcgggttggccaatgtgggcaacttcaacaccgggttcggaaatgtcggggacgtcaacctgggtgcggccaacatcggtgggcacaacctgggcctgggcaatgtcggggacggcaacctggggttgggcaacatcggccatggcaacctggggtttgccaacttgggcctgaccgccggcgcggcgggggtgggcaatgttggttttggcaatgccggcatcaacaactatggcttggcgaacatgggtgtgggcaatattgggtttgccaacaccggcacgggcaacatcgggatcgggctggtcggggaccatcggaccgggatcgggggcttgaactccggcatcggcaatatcgggttgttcaactccggcaccggcaacgtcgggttcttcaattccgggaccggcaacttcggcatcgggaactccggccgcttcaacaccgggatcggtaatagcggaacggccagcaccgggctcttcaatgccggcagcttcagcaccggcatcgccaacactggtgactacaacacgggcagcttcaacgccggcgacaccaacaccggtggcttcaacccgggcggcatcaacaccggctggttcaacaccgggcatgccaacaccgggttggccaacgcgggcaccttcggcaccggcgccttcatgacgggcgactacagcaacggcctgttgtggcggggcggctacgagggcctggtcggcgtccgcgtcgggcccacgatctcccaattcccggtcaccgtgcacgcgatcggcggggtgggcccgctgcatgtggcgcccgtcccggtacccgccgtgcacgtcgagatcaccgacgccaccgtcggcctgggtccgttcaccgtcccaccgatcagcattccctcacttcccatcgccagcatcaccggaagcgtggacctggccgcaaacaccatctcgccgattcgcgctcttgacccgctcgccggttcgatagggctttttctcgagccgttccgcctcagtgacccatttatcaccattgatgcgttccaagttgttgccggtgtcttgttcctagagaacatcattgtgcccggcctcacggttagcggtcagatattggtcaccccgacaccaattcccctaaccctcaacttggacaccaccccgtggacgcttttcccgaatggtttcaccattcccgcgcaaacccccgtgacggtgggtatggaggtcgccaacgacgggttcaccttcttcccgggtgggctgacctttccgcgggcctccgccggggtcaccggactgtccgtggggctggacgcgttcacgctgttgcccgacgggttcaccctcgacaccgtgccggcgaccttcgacggcaccatcctcatcggcgatatcccgatcccgatcatcgatgtgccggcggtgccggggttcggcaacaccaccacggccccatcgtcggggttcttcaacaccggcggcggcggtggatcggggttcgccaacgtcggcgcgggcacgtcgggctggtggaaccaggggcacgacgtgttagcaggggcgggctcgggagttgccaatgccggcacgctgagctcgggcgtgctgaacgtcggctcggggatctccgggtggtacaacaccagcaccctgggagcgggcaccccggcggtggtctcgggcatcggcaacctcggccagcagctgtcggggttcttggcaaatgggaccgtgctcaaccggagccccattgtcaatatcgggtgggccgatgtgggcgcgttcaacaccgggttgggcaatgtgggggacctcaactggggtgcggccaacatcggcgcgcagaacctgggcctgggcaatctcggcagcgggaacgtcgggttcggcaacatcggtgccggcaacgtcgggttcgccaactcgggtccggcggtgggcctggccggcctgggcaacgtggggttgagcaatgccggcagcaacaactgggggctggccaacctgggtgtgggcaacatcgggttggccaacaccggcacgggcaacatcgggatcgggctggtcggcgactaccagaccggcatcggcggcctcaactcgggtagtggcaatatcggattgttcaattccggcaccggcaatgtcgggttcttcaacaccggcaccggcaacttcggactgttcaactccggtagtttcaacaccggcatcggtaatagcggaaccggcagtactgggctcttcaatgccggcaatttcaacaccggcatcgccaaccccgggtcgtacaacacgggcagcttcaatgtcggtgataccaacaccggtggtttcaacccgggcgacatcaacaccggctggttcaacaccggcattatgaatacgggcacccgcaacaccggcgccctcatgtcggggaccgacagcaacggcatgctgtggcgcggcgaccacgagggcctgttcggcctgtcctatggcatcacgatcccgcaattcccgatccgcatcaccacgactggcggtatcggccccatcgtcatcccggacaccacgatccttccgccgctgcacctgcagatcaccggcgacgcggactacagcttcaccgtgcccgacatccccatccccgccatccacatcggcatcaatggcgtcgtcaccgtcggcttcaccgccccggaagccaccctgctgtccgccctgaagaataacggtagcttcatcagcttcggccccatcacgctctcgaatatcgatattccgcccatggatttcacgttaggcctgcccgttcttggtcctatcacgggccaactcggaccaattcatcttgagccaatcgtggtggccgggatcggtgtgcccctggagatcgagcccatccccctggatgcgatttcgttgagtgagtcgattcctatccgcatacctgttgatattccggcctcggtcatcgatgggatttcaatgtcggaagtggtgccgatcgatgcgtccgtggacatcccggcggtcacgatcacaggcaccaccatttccgcgatcccgctgggcttcgacattcgcaccagtgccggacccctcaacatcccgatcatcgacatcccggcggcgccgggcttcgggaactcgacccagatgccgtcgtcggggttcttcaacaccggtgccggcggcggatcgggcatcggcaacttgggtgcgggcgtgtcgggcctgctcaaccaggccggcgcggggtcactggtggggacactctcggggctgggcaatgccggcaccctggcctcgggtgtgctgaactccggcaccgccatctccgggctgttcaacgtgagcacgctggacgccaccaccccggcggtgatctcggggttcagcaacctcggcgaccatatgtcgggggtgtccatcgatggcctgatcgcgatcctcaccttcccacctgccgagtccgtgttcgatcagatcatcgacgcggccatcgccgagctgcagcacctcgacatcggcaacgctttggccttgggcaatgtcggcggggtgaacctcggtttggctaacgtcggtgagttcaacctgggtgcgggcaacgtcggcaacatcaacgtcggcgccggcaacctcggcggcagcaacttggggttgggcaacgtcgggaccggcaacctcgggttcggcaacatcggtgccggcaatttcggattcggcaacgcgggcctgaccgcgggcgcggggggcctgggcaatgtggggttgggtaacgccggcagcggcagctgggggttggccaacgtgggtgtgggcaatatcgggttggccaacaccggcaccggcaacatcgggatcgggctgaccggggactatcggaccgggatcggcggcctgaactcgggcaccgggaacctcgggttgttcaactcgggcaccggcaacatcgggttcttcaacaccgggaccgggaacttcgggctgttcaactcgggcagttacagcaccggtgtggggaatgcgggcacggccagcaccgggttgttcaacgcggggaacttcaacaccggtctggccaatgccggctcctacaacaccggcagcctcaacgtgggcagcttcaacaccggcggcgtcaacccgggcaccgtcaacaccggctggttcaacaccggccacaccaacaccggcctgttcaacaccggcaacgtcaacaccggcgcgttcaactccggcagcttcaacaacggggcgctgtggaccggtgactaccacgggctggtcggcttctccttcagcatcgacatcgccggcagcaccctgctggacctcaacgaaaccctcaacctgggccccatccacatcgagcagatcgacatccccggcatgtcgctgttcgacgtccacgaaatcgtcgagatcggacccttcaccatcccgcaggtcgatgttcccgcgataccgctagagatccacgaatcgatccacatggatcccatcgtcctggtgcccgccaccacaattcccgcacagacgagaaccattccgctggacatccccgcctcacccgggtcaaccatgacgcttccgctcatcagcatgcgcttcgaaggcgaggactggatcctcgggtcgaccgcggcgattcccaatttcggagaccccttcccggcgcccacccagggcatcaccattcacaccggccctggccccggaacgaccggcgagctcaagatatctattccgggtttcgagattccgcaaatcgctaccacgagattcctgttggacgtgaacatcagcggtggtctgccggccttcaccttgttcgcgggtggcctgacgatccccacgaacgccatcccgttaacgatcgatgcgtccggcgcgctggatccgatcacgattttcccgggtgggtacacgatcgacccgctgccgctgcacctggcgctgaatctcaccgtgcccgacagcagcatcccgatcatcgatgtcccgccgacgccagggttcggcaacaccacggcgaccccgtcgtcggggttcttcaactccggcgccggtggggtgtcggggttcggaaacgtcgggtcgaacctgtcgggctggtggaaccaggcggcgagcgcgctggcggggtcgggatcgggggtgttgaatgtcggcacgctgggctcgggtgtgctcaacgtcggctcgggtgtctcggggatctacaacaccagcgtgttgccgctcgggacgccggcggtgctgtcgggcctcggcaacgtcggccatcagctgtcgggcgtgtctgcggccgggaccgcgttgaaccagatccccatcctcaacatcgggttggcggatgtgggcaacttcaacgtcgggttcggcaacgtcggggacgttaacctgggcgcggccaacctcggtgcgcaaaacctggggctgggcaacgtcggcaccggcaacctcggcttcgccaacgtcggccacggcaatatcggtttcggcaattcgggtctgaccgccggcgcggccggcctgggcaacacggggttcggcaatgccggcagcgccaactatggtttcgccaaccagggcgtgcgcaacatcgggttggccaacaccggcaccggcaacatcgggatcgggctggtgggggacaacctcaccggcatcgggggcctgaactccggtgccggcaatatcggcttgttcaactccggcaccggcaacatcgggttcttcaactccgggaccggcaacttcggcatcggtaactcgggcagcttcaacaccggcatcggcaatagcggaacgggcagcactgggctcttcaatgccggcagcttcaacaccggcgtggccaacgccggcagctacaacaccggcagcttcaatgccggcgacaccaacaccggggggttcaacccgggcaccatcaacaccggctggttcaacaccggccacaccaataccggcatcgccaactcgggcaacgtcggcaccggcgcgttcatgtcgggcaacttcagcaacggcctgttgtggcggggtgatcacgagggcctgttcagcctgttctacagcctcgacgtgccccggatcaccatcgtggacgcccacctcgacggcggcttcggacccgtggtcctcccgcccatcccggtgccggccgttaatgcgcacctgaccggaaacgtcgcgatgggcgcattcaccattccgcagatcgacatccccgcactcaccccaaacatcaccggaagcgccgccttccgcatcgttgtggggtccgtgcgcattccgccggtgagtgtcattgtggagcaaataatcaacgcctcggttggggcggagatgaggatagatcccttcgaaatgtggactcaaggcactaatggccttggtataaccttctattcattcggatcggccgacggttcgccctacgccaccggcccactcgttttcggcgccggcacgagcgacggaagccatctcaccatttccgcgtccagcggggcgtttaccactccgcagctcgaaactggcccgatcacgttgggcttccaggtgcccggcagcgtcaacgcgatcaccctcttccccggtggtttgacgttcccggcgacctcgctgctgaacctggacgtgaccgccggcgccggcggcgtggacatcccggccatcacctggcccgagatcgcggcgagcgccgacggctcggtgtatgtcctcgccagcagcatcccgctgatcaacatcccgcccaccccgggcattgggaacagcaccatcaccccgtcgtcgggcttcttcaacgccggcgcgggcgggggatcgggcttcggcaacttcggcgcgggcacctcgggctggtggaaccaggcgcacaccgcgctggcgggggcgggctcgggttttgccaacgttggcacgctgcattccggtgtgctcaacctgggctcgggtgtctcggggatctacaacaccagcacgctgggggtggggaccccggcgctggtctcaggcctgggcaacgtcggccaccaactgtcggggctgctttccggcgggtccgcggtgaacccggtgaccgttctgaatatcgggttggccaacgtcggcagccacaacgccggtttcggcaatgtcggggaggtcaacctgggcgcggccaacctcggcgcgcacaacctgggcttcggaaatatcggcgccggcaacctggggttcggcaatattggccacggcaatgtcggagtcggcaactcgggtctgaccgcgggcgtgccgggcctgggcaatgtggggttgggcaatgccggcggcaacaactgggggttggccaacgtgggcgtgggcaatatcgggttggccaacaccggcaccggcaacattgggatcgggctgaccggcgactaccagaccggcatcggcggcctaaattccggtgccggcaacctggggttgttcaactccggcgccggcaacgtcgggttcttcaacaccgggaccggcaacttcgggttgttcaactccggcagcttcaacaccggcgtcggcaatagcggaacgggcagcactgggctcttcaatgccggcagtttcaacaccggtgtggccaacgccggcagctacaacacgggcagcttcaatgtcggtgacaccaacaccgggggcttcaacccgggcagcatcaacaccggctggctcaacgccggcaacgccaacaccggggtggccaacgcgggcaatgtcaacaccggcgccttcgtcaccggcaacttcagcaacggcatcctgtggcgcggcgactaccagggcctggccggcttcgccgtgggctacaccctcccgctgttccccgcggtgggcgccgacgtcagcggcgggatcggcccgattaccgtgctgccgcccatccacatcccgcccattccggtcggcttcgccgcggtcggtggcatcggcccgatcgccatcccggacatctctgttccatccattcacttgggcctcgaccccgccgtccatgtcggctccatcaccgtcaaccccattaccgtcaggaccccgcccgtgctcgtcagttactcccaaggagccgtcaccagcacgtccggaccaacctcagagatttgggtcaagcccagcttcttccccggaatccggatcgcgccctctagcggcgggggtgcaacgtccacgcaaggggcatactttgtggggcccatctccatcccctccggcacggtgaccttcccgggattcaccatccccctcgacccgatcgacatcggcctgccggtgtcgctgaccatcccggggttcaccatcccgggcggcaccctgatccccaccctcccgctgggcctcgcgttgtccaatggcatcccgcccgtcgacatcccggccatcgttctcgaccggatcttgctggacctgcacgccgacaccactatcggcccgatcaacgtcccgatcgccgggttcggcggggcgccgggtttcgggaactcgaccacgctgccgtcgtcgggcttcttcaacaccggagctggcggcggttcgggctttagcaacaccggcgcgggcatgtcgggattgctcaacgcgatgtcggatccgctgctcgggtcggcgtcgggcttcgccaacttcggcacccagctctccggcatcctcaaccgcggcgccggcatctcgggcgtgtacaacaccggcgcgctgggtgttgtcaccgcggccgtcgtctcgggtttcggcaacgtcggccagcaactgtcgggcttgctcttcaccggcgtcgggccctaa

SEQ ID NO: 475 - DNA, 582 bp, Mycobacterium Tuberculosis
gtggccttaaagcactctgaggcatccggcaccgcgtcgacgaagatcgtcatcgcgggcggattcgggtccggcaagaccacattcgtcggcgctgtttcggagatcatgccgttgcgcaccgaagcgatggtcaccgatgcctccgccggcgtcgacatgctggaggccactcccgacaagcggagcaccacggtggcgatggacttcggccgcatcaccttgggcgaggatctggtgctttatctattcggtaccccgggccagcgccggttctggttcatgtgggacgacctggtgcgtggtgccatcggggcgatcgtcttggtcgactgccggcgtctgcaggacagctttgcggcggtcgacttcttcgaacaccgcaacctgccgttcttgatcgccatcaacgagttcgacagcgcgccaaggtatccggttagcgcggtgcgcgacgcgttgacgctgcccgcacacattccggtgatcaatgttgacgcccgcaatcgcaggtcggcgaccgatgcactgatcgcggtgagcgaatacgcgctggccaccctgtctcctgcgggcggttga

SEQ ID NO: 476 - DNA, 393 bp, Mycobacterium Tuberculosis
atgaaagcccgcttgccggacagcccgcttgactggctggtgtcgaagttcgcccgcgaggttcccggggtggcccatgcattgctggtgtcggtcgacgggcttcccgtggcggccagcgaacatctaccacgcgaacgcgccgatcagttggccgcggtgacgtccgggctggccagcctggccggcggcgccgcgcaactgttcgacggcgggcaggtgctgcagtcggtggttgagatgcagaacggctacctgctgttgatgcaggtgggagacgggtcggcgctggcggcgctggccgcgaccggatgcgatatcggccagatcggttatgagatggccatccttgtcgagcgggtgggcggcgttgttcaatcctgccggcgatag

SEQ ID NO: 477 - DNA, 1767 bp, Mycobacterium Tuberculosis
atgtcgtttgtcgtagcagtcccggaggcattggcggcggccgcgtcggatgtggcgaacatcggttctgcgctaagtgccgcgaatgcagcggcagccgccggcacaacggggctactggcagccggtgccgacgaggtctcggccgccctggcgtcgctgttttccgggcacgctgtgagctaccaacaggtcgcggcccaggcgacggcgttacacgatcagtttgtccaggccttgaccggtgccggcggatcgtacgccctcaccgaggccgccaacgtccagcagaatctgctgaacgcaattaacgcgcccactcaggcgctgttggggcgcccgttaattggcgacggggctgtcggcaccgccagcagccccgacgggcaagatggcggtctgctgttcggcaacgggggcgccggctacaacagcgccgccacgcccggaatggccggcggcaacggcggcaacgccggattgatcggcaacggcggtactggcgggtcgggcggtgccggcgcggccggtggcgccggcggcagcggcggctggttgtacggcaacggcggaaacggcggcatcggcgggaatgcgatcgtcgcgggcggtgccggcggcaatgggggcgctggcggcgccgccggattgtggggcagtggcggcagcggcggccaaggcggcaacggtctgaccggcaacgacggcgtgaatccggcccccgtcacaaaccccgcgctaaatggcgccgccggcgacagcaatatcgagccgcaaaccagcgtcctgatcggcacccaaggcggtgacggcacgcccgggggtgctggcgtcaacggcggcaacggtggcgcgggcggagacgccaatggcaaccccgcaaacacctcgatcgccaacgcaggcgccggcgggaacggcgccgccggcggtgacggcggtgccaatggcggtgcgggcggcgccggcgggcaggccgcgtccgccggtagttccgtcggcggtgacggcggcaacggcggtgccggcggtacgggcacgaacgggcacgccggcggtgcgggcggcgccggcggtgccggtggtcgcggcgggtggctggtcggcaacggtggcaacggtggcaacggtgccgccggcggcaacggcgccatcggcggtaccggtggtgccggcggcgtccccgccaaccagggcggtaacagcgccctaggcacccagccggtcggcggcgacggcggcgacggcggcaacgggggcaccggaggcaccggcgggcgtggcggcgacggcggatccggcggcgcgggcggcgcgagcggttggttgatgggcaacggcggcaacggcggcaacggcggcaccggcggctcaggcggtgtcggcggcaatggcggcatcggcggtgacggcgccggcggcggaaacgccacgagcacgtcgagcatccccttcgacgcccacgggggtaacggcggcgctggtggcgacgctggtcacggcggaacgggcggcgacggcggtgacggggggcatgccggcaccggtggacgtggcgggttactggccggccagcacgccaactccggcaatggcggtggcggcggtaccggcggtgccgggggcacccatggcacccccggcagcggcaacgcaggcggcaccggcaccggtaacgctgacagcacaaacggcgggccaggcagcgacggcctcggcggggacgcgtttaacggcagtcgcggcaccgacggcaaccccggctaa

SEQ ID NO: 478 - DNA, 654 bp, Mycobacterium Tuberculosis
ttgagcattagcgcggttgttttcgaccgtgacggtgtgctcaccagctttgactggacacgtgccgaggaggatgtgcggcgaatcacgggcctaccattggaggagatcgaacgccgctggggtgggtggctcaacggattgactatcgacgacgcgttcgttgaaacccagccaattagcgagttcctctcgagcctggcgcgcgagctcgagctcggttcgaaggcaagagacgagctagtgcgcctcgactacatggcgttcgcccagggatatccagacgcgcgtccagcccttgaagaagcccggcgccgtggcctcaaggtcggtgttctcacaaacaacagcctgttggtcagcgcccgcagcctccttcagtgcgccgctctgcacgacctcgtcgacgtcgtgctgagttcgcagatgatcggagctgccaagcctgacccgcgggcctatcaagcgatcgcggaagccctcggcgtctcgacaacgtcatgcctgttcttcgacgacatcgccgactgggttgagggcgcacggtgcgcgggcatgcgcgcgtacctcgtggaccgttccggacaaactcgcgacggcgtcgttcgcgatttgtccagccttggagcgatcctggacggcgcgggaccatga

SEQ ID NO: 479 - DNA, 1053 bp, Mycobacterium Tuberculosis
atgggaggcgtattgactctggatgcggcttttctggggagtgtccctgctgaccttgggaaagcattgttagaacgggctcgagcggattgtggccctgtgctgcatcgggccattgagtcgatgcgcgagccgttggcgacgatggcgggatatcaccttggctggtggaacgccgatcgatccacagcggcaggatcgtcgggcaagtattttcgcgccgcccttgtctacgcggcggccgcggcttgcggtggtgatgtcggtgatgctactccggtgtcggcggctgtggagttggtgcacaacttcacgttgttgcatgacgatgtgatggatggggatgcgactcgcaggggacggccgacggtatggagtgtgtggggtgtgggcgtcgcgatcctgttgggagatgcgttgcacgccacggccgttcggatactgaccggcctgaccgacgagtgtgtggcggtcagggcgataaggcgattgcagatgtcgtgcctggacttgtgtatcggccagtttgaggattgtttattggagggacagcccgaagttacagtcgatgactatctgcggatggccgcgggcaagacggccgccctgaccggttgttgttgcgctctgggagctttagtggccaatgcagacgacgcgacgattgctgcgttggagcgttttggccatgagttgggtcttgcgtttcaatgcgtcgacgatctgatcggcatctggggtgaccctggtgtgacgggaaagccggtcggcaacgaccttgcccgacgtaaggcgacactgccagttgttgccgccctgaactcgcgatccgaagcggcgaccgaattggcggccctctatcaagcacctgccgcaatgacagcaagcgatgtcgagcgggctaccgcgcttgtcaaggtggccgggggtggtcatgtggcgcagcgatgcgccgatgaacgcatccaggctgctattgcggcactgcccgatgcggtgcgatccccagacctgatcgcgttgtcgcaactgatatgtcgccgggagtgctga

SEQ ID NO: 480 - DNA, 393 bp, Mycobacterium Tuberculosis
atggcggccatctatctcgactcgtccgcgatcgtcaagctcgcggttcgcgagccagagtcggacgcgctgcgccgctaccttcgcacccgccacccgcgagtgtcgagtgcccttgcgcgcgcggaggtcatgcgggccctgcttgacaagggtgaatcagcgcggaaagccggccgccgggcgctggctcatctcgatctgctgcgcgtcgacaagcgcgtcctcgatctcgctggtgggctgctgccattcgagctgcgcacgctcgatgccatccacttggcgacggcgcagcggctcggcgtcgatctgggccggttgtgcacctacgacgaccggatgcgcgacgccgccaagacgctcggcatggccgtgatcgccccgtcgtga

SEQ ID NO: 481 - DNA, 705 bp, Mycobacterium Tuberculosis
gtgtttcgtactgtaggcgatcaggcatcgttgtgggaatccgtgctgcccgaggagttgcggcggctgcccgaagagctggcccgggtggatgcgctgctcgatgattcggcgttcttctgcccgtttgtgccgttcttcgacccgcggatgggtcggccgtccataccgatggagacctatttgcggttgatgttcttgaagttccgttaccggttgggctatgagtcgctgtgtcgggaggtcaccgattcgatcacctggcggcggttctgccgtattccgttggagggatcggtgccgcacccaaccacgttgatgaagctgaccacgcgctgcggtgaggatgcggtggccgggctcaatgaggcgctgctggccaaggcggccagcgaaaagctgttgcgcaccaacaaggtccgtgccgacaccaccgtggtggagggcgatgtgggctatcccaccgacactggactgctcgccaaggcggtcggctcgatggcgcgcaccgtggcgcggatcaaagccgcggacgcgggatcggcgccgctcggtgggtcgtcgggcccgcgcgatcgcctccaagctgcggttacgcggcgcgcagcaacgcgatcaggcgcaggccttcgtgcgccggatcaccggggagctagccgggatcgccgagcaggcgctgaccgaggctgccgcggtggtacgtaa

SEQ ID NO: 482 - DNA, 873 bp, Mycobacterium Tuberculosis
atggcgattgatccgaactccataggtgcagtgaccgagccgatgttgttcgagtggaccgaccgggacacgctgctttacgcgatcggggtgggcgccgggaccggagatctggcgttcaccacggagaacagccacggcatcgaccagcaagtgttgccgacgtatgcggtgatttgctgtccggcgtttggtgcggccgcaaaggtgggaacattcaacccggcggcgctgctacacggctcccagggcatccggctgcatgcgccgctgccggcggcgggaaaactgtcggtggtcaccgaggtcgccgacatccaggacaagggggagggcaagaacgccatcgttgtgctgcgcggccgcggttgcgacccggaatcgggttcgttggttgccgaaacgcttaccacgttggtgcttcggggtcaggggggtttcggaggagcgcggggtgagcggccggccgcgccggaatttccggaccgccaccccgacgcccgaatcgatatgccgacccgtgaggaccaggcgctgatctaccggctctccggtgaccgcaacccgctgcacagcgacccctggttcgccacgcagctggccgggtttcccaagccgatcctgcacgggttgtgcacctacggggtggcgggccgggcgctggtggccgagcttggcggcggtgtggcggccaacatcacctcgatcgccgcgcggttcaccaagccggtgtttcccggcgagacgctgtcgacggtgatctggcgcaccgagccgggccgggcggtgttccgcaccgaggtggccggctccgacggcgccgaggcccgggtggtgctcgacgacggcgcggtggagtacgtggcgggttag

SEQ ID NO: 483 - DNA, 1239 bp, Mycobacterium Tuberculosis
atgaagatccgaacgttatccggctcggtgctggagccgccgtccgcagtacgcgcgaccccaggcacgtccatgttaaaactcgagccgggtggctcgacgatccccaagatccccttcatccgcccgagctttcccgggccagccgagctcgccgaggacttcgtacagatcgcccaggctaactggtacacgaacttcggtccgaacgagcggcggtttgcccgcgccctgcgcgactatctgggacctcatctgcacgttgctaccctcgccaacggcaccctggcactcctcgcggcgctccacgtcagtttcggcgccggtacgcgggaccgctacctgctgatgccgtcgttcacgttcgtcggcgtggctcaggctgcgctatggactgggtaccgtccctggttcatcgacatcgacgccaacacatggcagccatgcgtccactccgcccgcgccgtcatcgaacgcttccgcgaccggatcgccggcatcctgctggccaatgtgttcggcgtcggcaatccccagatcagcgtctgggaggagctcgccgccgaatgggagctaccgattgtgctcgactcggcggccggcttcggctccacgtacgccgacggcgagcgcctcggtggacgcggtgcatgcgagatcttctccttccatgcgaccaagccgttcgcggttggtgagggcggcgctctggtttctcgcgatccacggctcgtcgagcacgcatacaagttccagaacttcggcttggtgcaaacacgcgagtccatccagctcggaatgaacggcaagctgtcggagatcagcgccgctattggcctacgccaactagtcgggcttgatcgccgcctggcaagtcgccgcaaggtcctcgagtgctatcgcaccggtatggccgacgcgggtgtgcgtttccaggacaacgccaatgttgcgtcgctctgtttcgcgagcgcttgctgcacgtccgccgaccacaaggccgcggttctgggtagcctgcgtaggcacgcgatcgaggcgcgcgactactacaacccaccgcagcaccgacatccgtactttgtgacgaatgccgagttagtcgagtcgaccgatctagccgtcacggcggacatttgctcgcgaatcgtgtcgctgccagtccacgaccacatggccccggatgacgttgcccgggtcgtcgccgccgtgcaggaagcggaggtgcgcggtgaatga

SEQ ID NO: 484 - DNA, 300 bp, Mycobacterium Tuberculosis
atgcgtgctaccgttgggcttgtggaggcaatcggaatccgagaactaagacagcacgcatcgcgatacctcgcccgggttgaagccggcgaggaacttggcgtcaccaacaaaggaagacttgtggcccgactcatcccggtgcaggccgcggagcgttctcgcgaagccctgattgaatcaggtgtcctgattccggctcgtcgtccacaaaaccttctcgacgtcaccgccgaaccggcgcgcggccgcaagcgcaccctgtccgatgttctcaacgaaatgcgcgacgagcagtga

SEQ ID NO: 485 - DNA, 900 bp, Mycobacterium Tuberculosis
atgcgtgaatttggtaatccccttggcgatcggccgccattggatgagctggcccgcaccgatctgctgctcgacgcactcgccgaacgggaggaggttgacttcgcggatcctcgcgatgacgcgttggccgccctgctcggacagtggcgcgacgacttgaggtggccgccggccagtgccctggtttcacaggacgaggccgtcgccgcgttgcgcgccggggtagcgcaacggcgacgggctcgtcgcagcctggcggccgtcgggtcggtggccgcggcgctgttggtgctgagcgggttcggcgccgtggtggccgatgctcgccccggggacctgttgtacggcctgcacgcgatgatgttcaaccgatcgcgggtcagcgacgatcagatcgtgctgtcggccaaggccaatctggcgaaggtcgagcaaatgattgcccaaggccaatgggccgaggcgcaggatgagctggctgaggtcagcagcaccgtgcaggccgtgactgacggtagccgccggcaggacctgatcaacgaggtgaacctgctgaataccaaggtggagacgcgcgacccgaacgccacgctgcggcccggctcgccgtccaaccctgcggctccgggttcggtgggaaactcgtggactccgctggctccagtcgtcgagccgccgacccccccgacgcctgcatcggcagctgaaccgtcgatgtcggcaggcgtctcggagagccccatgccgaactccacgtccacggtggcagccagccccagcacgccgtcatcaaaacccgagccgggctcaattgacccctcgttggaacccgccgacgaggcgacgaatccggcggggcagccagcaccggaaacgccggtgagtccgacgcactag

SEQ ID NO: 486 - DNA, 1620 bp, Mycobacterium Tuberculosis
atgagcaagctgatcgaatacgacgaaaccgcgcgtcgcgccatggaggtcggcatggacaagctggccgacaccgtgcgggtgacgctggggccgcgcggccggcatgtggtgctggccaaggcgtttggcggacccacggttaccaacgacggcgtcacggtggcacgtgagatcgagctggaagatccgtttgaagacttgggcgcccagctggtgaagtcggtggccaccaagaccaacgatgtggccggtgacggcaccaccaccgcaaccatcttggcgcaggcactgatcaagggcggcctgaggctagtggccgccggcgtcaacccgatcgcgctcggcgtgggaatcggcaaggccgccgacgcggtatccgaggcgctgctggcatcggccacgccggtgtccggcaagaccggcatcgcgcaggtggcgacggtgtcctcgcgcgacgagcagatcggtgacctggttggcgaagcgatgagcaaggtcggccacgacggcgtggtcagcgtcgaagaatcctcgacgctgggcaccgagttggagttcaccgagggtatcggcttcgacaagggcttcttgtcggcatacttcgttaccgacttcgataaccagcaggcggtgctcgaggacgcgttgatcctgctgcaccaagacaagatcagctcgcttcccgatctgttgccattgctggaaaaggttgcaggaacgggtaagccactactgatcgtggctgaagacgtggagggcgaagcgttggcgacgctggtcgtcaacgcgattcgcaagacgttgaaagcggtcgcggtcaaggggccgtacttcggtgaccgccgtaaggcgttccttgaggacctggcggtggtgacgggtggccaggtggtcaaccccgacgccggcatggtgctgcgcgaggtgggcttggaggtgctgggctcggcccgacgcgtggtggtcagcaaggacgacacggtcattgtcgacggcggcggcaccgcagaagcggtggccaaccgggcgaagcacttgcgtgccgagatcgacaagagcgattcggattgggatcgggaaaagcttggcgagcggctggccaaactggccggcggggttgctgtcatcaaggtgggtgccgccaccgagaccgcactcaaggagcgcaaggaaagcgtcgaggatgcggtcgcggccgccaaggccgcggtcgaggagggcatcgtccctggtgggggagcctcgctcatccaccaggcccgcaaggcgctgaccgaactgcgtgcgtcgctgaccggtgacgaggtcctcggtgtcgacgtgttctccgaagcccttgccgcgccgttgttctggatcgccgccaacgctggcttggacggctcggtggtggtcaacaaggtcagcgagctacccgccgggcatgggctgaacgtgaacaccctgagctatggtgacttggccgctgacggcgtcatcgacccggtcaaggtgactaggtcggcggtgttgaacgcgtcatcggttgcccggatggtactcaccaccgagacggtcgtggtcgacaagccggccaaggcagaagatcacgaccatcaccacgggcacgcgcactga

SEQ ID NO: 487 - DNA, 303 bp, Mycobacterium Tuberculosis
gtggcgaaggtgaacatcaagccactcgaggacaagattctcgtgcaggccaacgaggccgagaccacgaccgcgtccggtctggtcattcctgacaccgccaaggagaagccgcaggagggcaccgtcgttgccgtcggccctggccggtgggacgaggacggcgagaagcggatcccgctggacgttgcggagggtgacaccgtcatctacagcaagtacggcggcaccgagatcaagtacaacggcgaggaatacctgatcctgtcggcacgcgacgtgctggccgtcgtttccaagtag

SEQ ID NO: 488 - DNA, 3711 bp, Mycobacterium Tuberculosis
atgaattcagggccggcgtgcgcgactgcggacatcctggttgccccgccgcccgagttgcggcggtcggaaccgtccagcctgctgattcgcctgctcccggtcgtcatgtcggtggcgaccgtgggtgtcatggtgacggtgttcttgccgggctcgccggccacgcgccaccccacgtttctggccttcccaatgatgatgctggtctcgttggtggtgactgcggtaaccggacgcggccggcggcatgtctccggtatccacaacgaccgtgtcgactacctcgggtacctgagtgtcttgcgcacatctgtcacccaaacggctgcagcacaacacgtatcactgaactggacgcatcccgatcctgccaccttgtggacattgatcggtggtccgcgaatgtgggagcgtcgaccgggtgctgccgacttctgtcgcatccgtgtcggagttggatctgcaccgctggccacccgcttggtggtcgggcagcttccgccggcgcagcgtgcggatccggtcacccgcgccgcgctgcgctgtttccttgccgcacacgcgaccattgcggatgcgcccatcgcgatccccttgcgggtcggcggtccgatcgccatcgacggtgacccgaccaaggtccgcgggctgctgcgggcgatgatctgccagctggccgtatggcactcaccggaggagttgctgatcgccggcgtggtcagtgaccgcaaccgcgcgcactgggattggctgaaatggctgccgcacaaccaacatccgaatgcctgtgatgccttggggccagccccgatggtgtactcgaccctggcagagatgcaaaatgcgctagccgcaacggtattggcccacgttgttgcgatcgtcgacacggccgaacgtggcaacggcgcgatcaccggcgtgatcacgatcgaggtgggcgccagacgagacggtgcaccgccggtggtcagatgtgccggcgaagtgacagcgctagcgtgcccggaccagctggagcctcaagacgcgctggtatgcgcccgtcggctggccgctcaccgggtcgggcactcgggtcgcacgttcatccgtggctcgggttgggcggaactggtcggcatcggcgatgtggccgctttcgatccgagcacgttgtggcgcaacgtaaaccaacatgatcggctccgtgtcccgatcggagtcacgcccgacggtaccgccgtgcagctagacatcaaggaagccgcggaacagggcatgggtccacacgggctgtgcgtcggcgccaccggatcaggcaaatcggagctgctgcgtaccatcgcgctggggatgatggcacgcaattcgcccgaagtcctcaacctccttctggtcgacttcaagggtggtgcaacatttctcgacctcgcgggagccccacatgtagccgcggtcatcaccaaccttgccgaggaagcaccgctggtcgcacggatgcaagacgcattggccggcgagatgagccgccggcaacagctgctgcggatggcaggccacttggtcagtgtcacggcatatcagcgggcacgccaaacgggtgcgcaacttccctgcctgccgatcctgttcatcgtcgtcgacgagttttccgaattgctgagccaacatcccgaattcgtcgacgtgttcctcgcgatcggtcgggtgggccggtcgctgggcatgcatttgctgctggccagtcagcggctcgacgagggccgactgcgtggactggaaacccatctgtcctatcgaatgtgcctgaaaacgtggtccgccagtgaatcacgcaacgtgctcgggacgcaggacgcatatcaactgcccaacacccccggtgcgggcttgctgcaaacgggaaccggagagctgatccgatttcagaccgcgttcgtttccgggccgcttcgacgggcgagtccctcagcggtccacccggtagccccgccgtcggtgcgaccgttcaccacgcacgctgcggcgccggtcacagccggtcccgtcggcgggacagccgaggtgcccacgcctaccgtcttgcatgcggtgctcgaccggctggtcggtcatggaccggctgcgcatcaagtctggctaccgccgctggacgagccaccgatgctgggcgccctactgcgtgacgctgagccggcgcaggccgagctggccgtacccatcggcattgtcgatcggccgttcgagcagtcacgggtgccgctgacgatcgacttgtccggggccgcaggcaatgtcgcggtcgtaggtgcaccgcaaacgggcaagtcaaccgcgctgcggacgctgatcatggcgttggctgctacccacgatgcgggccgggtgcagttctattgtttggacttcggcggcggggcgctggcccaggtggacgaactgccgcatgtgggtgccgtggccggcagggcgcagccgcagctggcatcgcggatgctcgccgaactggagtcggccgtgcgatttcgggaggcattcttccgcgaccacggcatcgactcggtggcgcggtaccgccagctgcgagcaaagtcggccgctgagtcttttgcggacatatttcttgtcatcgacggctgggcaagcttacgccaggagttcgcggcccttgaggagtcgatcgttgccctggcagctcaagggctttcattcggcgtacatgtggcgctatcggcagcacggtgggcggagatcaggccgtcgctgcgggatcagatcggcagtcgaatcgagttacggctggcggatcccgcggattccgaattggaccgtaggcaggcgcaacgggtgccggtcgacagaccgggccgtggcctctcccgcgacgggatgcacatggtgatcgccctgcccgacctggatggagttgcgctacgacgccgaagtggtgatccggtggcgcccccgataccgctactgcccgcgcgcgtggactacgacagcgtcgtggcccgagccggcgacgaactcggtgcgcacatcttgctcggcctcgaggaacgtcgaggccagccggtggccgtcgatttcggacgccacccgcacctgctggtgctgggcgacaacgagtgcggaaagacggccgcgttgcggaccctgtgccgcgagatcgtccggacccataccgccgcgcgagcccaacttctcatcgtcgacttccggcacaccctgctcgacgtcatcgagtcggaacatatgagcggctacgtcagctcgccggcggcgctgggtgccaagctgtcgagtctggtcgacctgctccaggcgcggatgcccgccccggatgtgagccaggcgcagctgcgagccaggtcctggtggtcgggtccggatatctatgtcgtggtcgacgactacgacctggttgcggtctcatcgggcaacccgctgatggtcttgctcgaatatttgccgcacgcaagagatctcggtttacacctggtggtggcgcggcgcagcgggggtgctgctcgggcgctgttcgagccggtgcttgccagcctgcgtgacctgggctgccgggcactgctgatgagcggacgtccggatgaaggcgcactgttcgggtcgagccgcccgatgccgctgccaccgggccggggcatcctggtcaccggtgccggtgacgagcaactggttcaagtcgcctggagcccacccccgtga

SEQ ID NO: 489 - DNA, 771 bp, Mycobacterium Tuberculosis
gtggggcagcgcacggtcgcgggcgatctcgatgcggcgctgactaccatcttccgcaccccggtgcggctgcgggcggccggacgcactgatgcgggcgtgcacgccagcggccaggtcgcccacgttgacgtgcccgccgatgccttgccgaacgcttacccgcgcgccggccacgtcggtgatccggaattcctgccgctgttgcggaggctgggtcgatttctgcccgccgacgttcgaatcctcgatatcacgcgcgcaccagcgggtttcgacgccagattctcggcgctgcggcggcattacgtgtaccggctgtcgacagcaccctacggtgtcgagccgcagcaggcgcgctacatcaccgcttggccacgcgagcttgatctggatgcgatgacggccgcgtcgcgagatttgatggggctgcacgacttcgcggcgttctgccgtcatcgcgagggcgccaccacgattcgtgatctgcagcggctggactggtcgcgtgccggcaccctggtcaccgcgcacgtcaccgccgacgcgttctgttggtcgatggtgcggtcgttggtgggggcgctactggcggtcggcgagcaccgtcgcgcgacaacttggtgtcgtgagctgctcaccgcgacaggacgatccagcgacttcgcggtcgcgccggcgcacgggttgacgttgatccaggtggactatccgcccgatgaccagctcgcgtcacggaacttggtcacccgggatgtgcgctcgggctaa

SEQ ID NO: 490 - DNA, 543 bp, Mycobacterium Tuberculosis
atgcccaagcctaccaagggccctcgcctcggcgggtcgtcttcacatcagaaggcgatcttggccaacctcgccacgtccctgttcgagcatgggcggatcacgacgaccgagccgaaggcccgggcgctgcgtccgtacgcggagaagctgatcacgcatgccaaaaaaggcgcgttgcacaaccggcgcgaggtgctcaagaagctccgtgacaaggatgtggtgcataccttgttcgccgagatcggaccgttcttcgccgaccgcgatggtggctacacccgtatcatcaaaatcgaggcacgtaagggcgacaacgctccgatggccgtgatcgaactggtccgggagaagacggtgacctcggaggccaatcgagcacgccgggtagctgccgcgcaggcgaaggccaagaaggcggcggccatgccgaccgaggagtccgaggccaagcctgctgaggagggtgacgtggtcggcgccagtgagcctgacgcgaaggcccccgaagagccccccgcagaggcccccgagaattag

SEQ ID NO: 491 - DNA, 1044 bp, Mycobacterium Tuberculosis
atgctgatctcacagcgccccaccctgtccgaggacgtcctcaccgacaaccgatcccagttcgtgatcgaaccgctggagccgggattcggctacaccctgggcaattcgctgcgtcgcaccctgctgtcgtcgattcccggagcggccgtcaccagcattcgcatcgatggtgtactgcacgaattcaccacggtgcccggggtcaaagaagatgtcaccgagatcatcctgaatctcaagagcctggtggtgtcctcggaggaggacgagccggtcaccatgtacctacgcaagcagggtccgggtgaggttaccgccggcgacatcgtgccgccggccggcgtcaccgtgcacaaccccggcatgcacatcgccacgctgaacgataagggcaagctggaagtcgagctcgtcgtcgagcgtggccgcggctatgtcccggcggtgcaaaaccgggcttcgggtgccgaaattgggcgcattccagtcgattccatctactcaccggtgctcaaagtgacctacaaggtggacgccacccgggtcgagcagcgcaccgacttcgacaagctgatcctggacgtggagaccaagaattcaatcagcccgcgcgacgcgctggcgtcggctggcaagacgctggtcgagttgttcggcctggcacgggaactcaacgtcgaggccgaaggcatcgagatcgggccgtcgccggccgaggccgatcacattgcgtcattcgccctgccgatcgacgacctggatctgacggtgcggtcctacaactgcctcaagcgcgagggggtgcacaccgtgggcgaactggtggcgcgcaccgaatccgacctgcttgacatccgcaacttcggtcagaagtccatcgacgaggtgaagatcaagctgcaccagctgggcctgtcactcaaggacagcccgccgagcttcgacccctcggaggtcgcgggctacgacgtcgccaccggcacctggtcgaccgagggcgcgtacgacgagcaggactacgccgaaaccgaacagctttag

SEQ ID NO: 492 - DNA, 690 bp, Mycobacterium Tuberculosis
atgcgaggattgctgcccgtggcaggtcattgggtctccgtgctcaccgggctcgtgccgctggcgttggtcattgcgctctcgccgttgtcggtgatcccagcggtactggtcgtacactcgccgcagccgcggccgagcagcctggccttcctgggcggctggctgttgggcttggccgtggtgaccgccgtctttgttgcggcctccggcgcacttggcggtttgagcacaacatcgccggcctgggcatcctggctacgggtggtcctcgggtcggcactgatcgtgttcggcgtgcttcggtggctgacccggcatcgccacaccgaaatgccgggctggatgcgcgcattcgccagcttcaccccggcacgcgccggattggtaggggccgtgctggtggtggtgagacccgaggtgctgatcatttgcgcggcggccggattggccatcggcagcggcggccacggcgccgcgggttcctggatttacacggcattctttgccatgttggctgcatccacggtcgcgatcccgatattggcctacgtggctgccggtgaccgactcgacgattcgctggaacgacttaaagactggatggagaagaaccatgccgggatggtcgcggccattctggtcgtgatcggtttactgctgctctacaacggagttcacgcgatgtga

SEQ ID NO: 493 - DNA, 1695 bp, Mycobacterium Tuberculosis
atgatcgaccgactcgccaagatccagttgtccatttttgcggtgatcaccgtcatcaccctgagcgtgatggcgatcttttatctgcgtctgcccgccacgttcggcatcggaacctacggcgtgagtgccgacttcgtcgcgggcggtggcctgtacaagaacgccaacgtcacctaccgcggtgtcgcggtcgggcgggtggagtcggtggggctaaatcccaatggcgttaccgcgcacatgcgactgaacagtggcaccgccattccgtcgaacgtcaccgccaccgtacgcagcgtttcggccatcggtgagcagtacatcgacctagtgccgccggagaacccgtcgtcgaccaagttgcgcaacggcttccggatccagcggcagaacacccgaatcgggcaagacgtcgccgacctgttgcgtcaggccgagacgctgctcggcagccttggcgacacccggctgcgggagctgctgcacgaggcgttcatcgcgaccaatggcgccggtccggaactggcccggctgatcgagtcggcccggttgctggtggatgaggccaacgccaactatccacaggtttcgcagttgatcgatcaggccggcccgttcctgcaagcccagatccgcgccggcggggacatcaagtcactcgccgatgggctggcgcggttcacctggcagctccgtgcggcagacccgcggctgcgcgacacgttggccgacgccccggatgcgatcgacgaggccaacaccgcgttctccgggattcgtccttcgtttcccgcgctggcggccagtctggccaacctgggccgggtgggcgtgatctatcacaagtcgatcgaacagctcctggtggttttcccggcgctgttcgccgcgatcatcacctcggcgggcggcgtaccccaggacgagggcgccaagctggacttcaagatcgacctgcacgacccgccgccctgcatgaccgggttcttgcccccgccgctggtccggtcgccggccgacgagtcggtacgcgagattccccgggacatgtactgcaagaccgcgcagaacgacccgagcacggtgcgcggcgctcgcaactacccgtgccaggaattccccggtaagcgggcaccgacggtgcagttatgtcgggatccgcgtggctatgtgccagttggaaccaacccgtggcgcggtccgccgatcccgtacggcaccgaggtgacggatgggcgaaacattctgccgcccaacaagttcccttacatcccgccgggcgcggatcccgacccgggcgtgcccatcgtcggaccgccgccacccggccaggtggccggccccgggccggcgccgcaccagccggcgcagcctgcgccgccgcccaacgacaacggtccgcctccaccgttcacgtcatggatgccgcccgggtacccgccggagccaccccaggtgccatacccggcgaccattccgccgccgccaccaccggaaggcaccgggcctccgcccgggccggcgcctggcccccaaccgcaggccagcggtccggcctacaccatctatgaccaactcagcggagccttcgcggacccggccggcggcactggtatcttcgcgcccgggatgacgggcgcatccagcgccgagaattgggtggatctcatgcgcgatccgaggcagctgtag

SEQ ID NO: 494 - DNA, 5706 bp, Mycobacterium Tuberculosis
atgtcgttcgtgttgatcgcaccggaattcgtgacagcagccgcgggggatctgacgaatctgggttcgtcgattagcgcggccaacgcgtcggcagccagtgcgaccacgcaggtgctggctgcgggcgccgatgaggtgtctgcccgtattgcggcgctgttcggcgggtttggcctggagtaccaggcgattagtgcgcaggtggcggcctaccaccagcggtttgtgcaggccttgagtaccggcgcgggcgcatatgcctcggccgaggccgccgccgctgagcagatcgtgctgggcgtgatcaatgcgcccacccaggcgctgctggggcgcccgttgatcggtgacggcgccaatgcgacgactcccggcggggccggcggggccggcggtctgctgttcggcaacggcggggccggggcagccggggcgcccggccaggccggcgggcctggcgggcccgccggattgtggggcaacggcgggcccggcggggccggcggcagcggtgggggcaccggcggtgccggcggcgccggtgggtggctgttcggggttggcggcgccggcggtgtcggtggggccggtggcggcaccggcggggcgggcgggcccggtggtttgatctggggcggcggcggggccggcggtgtcggtggggccggtggcggcaccggcggggccggcggccgcgccgagctgctgttcggcgccggcggtgcgggtggggcgggcaccgacggcgggcccggtgctaccggcgggaccggcggacacggcggagtcggcggcgacggcggatggctggcacccggcggggccggcggggccggcgggcaaggcggggcaggtggtgccggcagcgatggtggcgcgttgggtggtaccggcgggacgggcggtaccggcggcgccggtggcgccggcggtcgcggcgcactgctgctgggcgctggcggacagggcggcctcggcggcgccggcggacaaggcggcaccggcggggccggcggagatggcgttctggggggtgtcggtggcactggtggtaagggcggtgtcggcggcgtggctggcctcggcggggccggtggtgccgcgggccagctcttcagcgccggaggcgcggcgggtgccgttggggttggcggcaccggcggccagggtggggctggcggtgccggagcggccggcgccgacgcccccgccagcacaggtctaaccggtggtaccgggttcgctggcggggccggcggcgtcggcggccagggcggcaacgccattgccggcggcatcaacggctccggtggtgccggcggcaccggcggccaaggcggcgccggcggcatgggtggctccggtgctgataatgccagcgggattggcgccgacggcggcgcgggtgggactggcggtaacgccggcgccggcggggccggcggggccgccggcaccggaggaaccggcggggttgtcggcgccgcgggcaaggccggtatcggcggcaccggcggccaaggcggcgccggcggcgcgggcagcgccggcacggatgcgaccgctaccggtgccaccggcggcaccgggttttccggtggagccggcggggccggcggggccggcggcaacaccggggttggcggcaccaacggctccggcgggcaaggcggcaccggcggcgcgggcggcgccggtggtgctggcggtgtcggcgccgacaaccccaccggcatcggcggcaccggcggcaccggcgggaaaggcggcgccggcggggccggcgggcagggcggtagcagcggtgccggcggcaccaacggctctggtggcgctggcggcaccggcggacaaggcggcgccgggggcgctggcggggccggcgccgataaccccaccggcatcggcggcgccggcggcaccggcggcaccggcggagcggccggagccggcggggccggtggcgccatcggtaccggcggcaccggcggcgcggtgggcagcgtcggtaacgccgggatcggcggtaccggcggtacgggtggtgtcggtggtgctggtggtgcaggtgcggctgcggccgctggcagcagcgctaccggtggcgccgggttcgccggcggcgccggcggagaaggcggagcgggcggcaacagcggtgtgggcggcaccaacggctccggcggcgccggcggtgcaggcggcaagggcggcaccggaggtgccggcgggtccggcgcggacaaccccaccggtgctggtttcgccggtggcgccggcggcacaggtggcgcggccggcgccggcggggccggcggggcgaccggtaccggcggcaccggcggcgttgtcggcgccaccggtagtgcaggcatcggcggggccggcggccgcggcggtgacggcggcgatggggccagcggtctcggcctgggcctctccggctttgacggcggccaaggcggccaaggcggggccggcggcagcgccggcgccggcggcatcaacggggccggcggggccggcggcaacggcggcgacggcggggacggcgcaaccggtgccgcaggtctcggcgacaacggcggggtcggcggtgacggtggggccggtggcgccgccggcaacggcggcaacgcgggcgtcggcctgacagccaaggccggcgacggcggcgccgcgggcaatggcggcaacgggggcgccggcggtgctggcggggccggcgacaacaatttcaacggcggccagggtggtgccggcggccaaggcggccaaggcggcctgggcggggcaagcaccacctcgatcaacgccaacggcggcgccggcggcaacggcggcaccggcggcaaaggcggcgccggtggtgcgggaaccctgggcgtcggcggctccggcggcaccggcggggacggcggcgatgcgggctctggtggtggcggcggcttcggcggggccgcgggtaaggccggcggcggcggaaacggcggccgcggcggtgacggcggcgatggggccagcggtctcggcctgggcctctccggctttgacggcggccaaggcggccaaggcggggccggcggcagcgccggcgccggcggcatcaacggggccggcggggccggcggcaacggcggcgacggcggggacggcgcaaccggtgccgcaggtctcggcgacaacggcggggtcggcggtgacggtggggccggtggcgccgccggcaacggcggcaacgcgggcgtcggcctgacagccaaggccggcgacggcggcgccgcgggcaatggcggcaacgggggcgccggcggtgctggcggggccggcgacaacaatttcaacggcggccagggtggtgccggcggccaaggcggccaaggcggcctgggcggggcaagcaccacctcgatcaacgccaacggcggcgccggcggcaacggcggcaccggcggcaaaggcggcgccggtggtgcgggaaccctgggcgtcggcggctccggcggcaccggcggggacggcggcgatgcgggctctggtggtggcggcggcttcggcggggccgcgggtaaggccggcggcggcggaaacggcggtgttggcggtgacggcggcgagggagccagcggtctcggcctgggcctctccggctttgacggcggccaaggcggccaaggcggggccggcggcagcgccggcgccggcggcatcaacggggccggcggggccggcggcaccggcggggccggtggtgacggcgccccggcgaccctgatcggcggacccgacggcggtgacggcggccaaggcggcatcggcggggacggcggcaacgccggattcggcgccggtgttcccggcgacggcggggacggcggcaacgccggattcggcgccggtgttcccggcgacggcgggatcggcggcaccggcggggccgggggcgccggcggcgccggcgccgacggggaccccagcattgacggcggccaaggtggtgccggcggccacggcggccaaggcggcaaaggcggcctgaacagcaccgggctagccagcgccgccagcggtgacggcggcaacggcggggccggcggggccggcggcaacggcggcgacggcgacggctttatcggcgggtccggcggcaccggcgggaccggcggcgacgccggcgtcggcggcctggccaacaccggcggaaccgcgggcaacgccggtatcggcggggccggcggccgcggcggcgacggcggggccggcgacagcggcgccctctcccaagacggcaacggcttcgccggcggccaaggcggccaaggcggggtcggcggcaacgccggcgccggcggcatcaacggggccggcggcaccggcggcaccggcggggccggtggtgacggccagaacggaacgacaggcgtggcgagcgagggcggcgccggcggccaaggcggtgacggcggccaaggcggcatcggcggggccggcggcaacgccggattcggcgccggtgttcccggcgacggcgggatcggcggcaccggcggggccgggggcgccggcggcgccggcgccgacggggaccccagcattgacggcggccaaggtggtgccggcggccacggcggccaaggcggcaaaggcggcctgaacagcaccgggctagccagcgccgccagcggtgacggcggcaacggcggggccggcggggccggcggcaacggcggcgacggcgacggctttatcggcgggtccggcggcaccggcgggaccggcggcgacgccggcgtcggcggcctggccaacaccggcggaaccgcgggcaacgccggtatcggcggggccggcggccgcggcggcgacggcggggccggcgacagcggcgccctctcccaagacggcaacggcttcgccggcggccaaggcggccaaggcggggtcggcggcaacgccggcgccggcggcatcaacggggccggcggcaccggcggcaccggcggggccggtggtgacggccagaacggaacgacaggcgtggcgagcgagggcggcgccggcggccaaggcggtgacggcggccaaggcggcatcggcggggccggcggcaacgccggattcggcgccggtgttcccggcgacggcgggatcggcggcaccggcggggccgggggcgccggcggcgccggcgccgacggggaccccagcattgacggcggccaaggtggtgccggcggccacggcggccaaggcggcaaaggcggcctgaacagcaccgggctagccagcgccgccagcggtgacggcggcaacggcggggccggcggggccggcggcaacggcggagccggcgggctcggcgggggcggtggcacaggcggcaccaacggcaacggcggcctcggcggaggcggcggcaacggcggagccggcggtgccgggggaacgcccaccggcagtggcaccgaggggaccggcggcgacggtggagatgccggcgccggcggcaacggcggctctgccaccggcgtcggtaacggcggtaacggcggtgatggcggcaacggcggcgacggcggcaacggcgcacccggcggcttcggtggcggcgctggcgccggcggcttgggcggctccggcgccggcggcggcaccgacggcgacgacggcaacggcggcagccccggcaccgacggcagctaa

SEQ ID NO: 495 - DNA, 3240 bp, Mycobacterium Tuberculosis
ccccaaggcgccgacggcaacgccggcaacggcggtgacggcggggtcggcggcaacggcggaaacggcgcagacaacaccaccaccgccgccgccggcaccacaggcggggccggcggggccggcggggccggcggaaccggcggaaccggcggagccgccggcaccggcaccggcggccaacaaggcaacggcggcaacggcggcaacggcggcaccggcggcaaaggcggcaccggcggcgacggtgcactcgcaggcagcagcggtggtgccggcggtaaaggcggcaacggcggcgacgccggcaaggccggtaccggctccgctcctggcacggcggggaccggcggcgatgggggtaagggcggcaacggcggcattggcgctgccggcacaaccggccccgtaggcaccggcgcgtccggcggcaccggtggtagtggtggcgccggcggaaccggcggtgacggcggcgccgccaacggcggcaccgccggggctggcggggcgggcggcaatggcggcaaaggcggcgacggtggagcaggcgtcaccagcagcaccgccggcaacagcggcggcgcgggcggcagcggcggaaagggcggagacgcgggcgcgggcggcgccggtgccactccgggcgccaacggtatcgctggcaatggcggcgacggcggagatggcgcggctggtgccgtcggcatctccggcgcaaccggcgctggcgacggcgggcatggcggaaccggcgcggccggcggcaacggtggaaccggcggtgctggcggtagcggcatcgacggcgtcggcggcgggaccggaggtaccggcggcaacggcggcaacggcgccatcggcggcgctggcggagacgccggtggtagcggaaatagcggcggaaacggtgggattggcggaaagggcggaaacgccggtgccggtggtgccgcgggcagcaacggcggtaccgtcggcgccaacggtaccggcggcgacggcggcaacggcggcgctgccggggccgccacggctggcagcaacggtggggccggcaccggctcggccggcggcaacggcggcaccggcggcagaggcggcagtggtggcgccggcggcgacggtatcggtggcgtcggcggcggcaagggcggcaacggcgcggacggcgaagtcggcggtgcgggcggcgccggcggcagcgggcccaacaccagtcccggcggcaacggcgggcaaggaggtcaaggcggcagcggtggtgccggtggggcggccggggctggcggcgccggtggcggcgctaacggcaccgctggcaacggcggccaaggcggtgccggcggcaccggcggcgccggcgcagcctcctcagctaccaacggcggcagcggcggcgccggcggcaccggaggcgacggcggcagcggcggcgccggcggcaccggaggcgccggcggcaccggcggggcggccggcgacggcggacaaggtggccagggcggcgccggcggcggtgccggtggtcaaggtggtgccggcggtgccggcgggaccggcggcaacggcggcaatatcaccggcggcaccgcgggcaccgcgggggccgccggtaacggcggcgccgccggaaagggtggcgccggcggccaaggcggcaccggtggcgggaccgggggtcagggtggcgccggcggcgacggcggtgccggcggcaccggcggcgaccgcaccgtcggcggtggcacggtccccgccggctccggtggacaaggcggtaacgctggcggtggtggggccggcgggcagggtggagccgacggcggcagcggcggcgacggcggcgacgccggcacaggtggcaatggcggtaacggcggcaaccgtaattccggcaatggcaccggcggcgctggcggcaacggtggtggtggtgctaacggtggcgccggcggcgctgggggcagcggcggcggcaccggcggcaacggcggcgctggcggcgacgccggcgacgccggcaacggcggcaacggcaacggcaccggcaacggcggcaacggcggcaacggcggcatcgccggcatgggcggcaacggcggtgccgggacgggcagcggcaacggcggcaacggcggcagcggcggcaacggcggcaacgccggcatgggcggcaacagcggcaccggcagcggcgacggcggtgccggcgggaacggcggcgcggcgggcacgggcggcaccggcggcgacggcggcctcaccggtactggcggcaccggcggcagcggtggcaccggcggtgacggcggtaacggcggcaacggagcagataacaccgcaaacatgactgcgcaggcgggcggtgacggtggcaacggcggcgacggtggcttcggcggcggggccggggccggcggcggtggcttgaccgctggcgccaacggcaccggcgggcaaggcggcgccggcggcgatggcggcaacggggccatcggcggccacggcccactcactgacgaccccggcggcaacgggggcaccggcggcaacggcggcaccggcggcaccggcggcgcgggcatcggcagccttggcggcggcactggcggcgatggcggcaacggcggcaacggcggtaccggcggcgagggcggcgaggtcggcggcgccggcggcaccggcggtgcggccggcaatggcggcgatggcggcaccggcggcaccggcggcggggacgggggcgccggcggcaccggcggcaccggcggcaccggcggcctcggcgacccccgggtcggcggatccggcggcgacggcggcaccggcggcagcggcggtgcggccggcaatggcggcaacggcggcaacgccggcgcgggaggcaatggcaacggcggcaccggtggggccggcggtatcggcggcaccggcggcaatggcggcgacgccgagcccggagtgcccccgggagccggtggtgctggcggcgccggcaccaccggcggcaagggtggcaccggcggcaacggcagtggcaccggctcgggcggcaccggcggcgatggcggcaccggcggtggtggtgggaacggcggcaccggctggaatggcggcaagggagacaccggcagcggcggtggcgccggagacggtggtaaggcaccagccggtggcaccggcggcgccggcggcgacggcggagcgggcggcaagggcggcagcggcggcgtctag

SEQ ID NO: 496 - DNA, 657 bp, Mycobacterium Tuberculosis
atggcggcatctttaagtgagaaccttagttgccactcatctaatatgtgccggctttctggtaatgccgcaacgaacctggagcgccctggggaggagccgcccggcgaccggtgcaccaggcgccaagcagtgcgacccgcgcgcacgctcgccaagaagggcaacattcccgtcggctactacaaggacgagaagaagacggccgagacgttccggacgattaacggtgtgcgctacgccattccgggggactacgcccaagtcgaggaggacggcacggtcaccatgctgggtcgtggctcggtgtcgatcaacagcggcggcgagaaggtctaccccgaagaggtcgaggccgctttgaaggggcatcccgacgtgttcgacgctctggtggtcggggtgcccgatccgcgttacggccagcaggtggccgccgtggtgcaggcccggccgggttgtcggccgtcgttggccgagttggactcgttcgtgcgctccgagatcgcgggctacaaagtgccgcgcagtctgtggtttgtcgacgaggtgaagcgttcgcccgccggtaagccggactaccgctgggccaaggagcagaccgaggcgcggccagccgatgacgtgcatgcgggacacgtgacgagcggttcctga

SEQ ID NO: 497 - DNA, 1647 bp, Mycobacterium Tuberculosis
gtggccgtggccctgaatattgccgatctcgccgagcacgccatcgacgccgtgcctgaccgtgtcgccgttatctgcggcgatgagcagttgacctacgcccagctggaggataaggccaaccgcctcgcgcaccacctgatcgatcaaggcgtgcaaaaggacgacaaggtcggcctgtactgccgcaaccgcatcgagatcgtgatcgcgatgctgggcatcgtgaaggcgggcgccatcttggtgaacgtcaacttccgttacgtggagggcgaacttcgctacctgttcgacaactccgacatggtcgcgttggtgcacgaacgccgctacgccgaccgggtcgccaacgttctccccgacacgccccatgtaaggacgatcttggtcgtcgaggacggctcggaccaggactatcggcgctacggcggcgtcgagttctattccgcgatcgcggcgggctcgccggagcgtgacttcggcgaacgcagcgccgacgccatctatctgctctacaccggcggcaccaccggtttccccaagggtgtgatgtggcgtcacgaggacatctatcgtgtgctgttcggtggaaccgactttgcgacaggagagttcgtcaaagacgaatacgacctggccaaggcggccgcggcgaatccaccgatgatccgctacccgatcccgccgatgatccacggcgccacccagtcggccacctggatggcgctcttctcgggccaaaccacggtactggcaccggaattcaacgccgacgaggtgtggcgcacgatccacaaacacaaggtgaacctgctgttcttcaccggtgatgcgatggcccgcccgctggtcgacgcgctggtcaagggcaacgactacgacctgtcgtcgttgttcctgttggccagcaccgcggcgctgttctcgccgagcatcaaggagaaactccttgagctgctgccgaatcgggtgatcacggactcaattggctcgtcggagacgggttttggcggtaccagcgtcgttgctgccgggcaggcgcatggcggcgggccccgggtgcggatcgaccatcgcaccgtcgtgctcgatgacgacggcaacgaagtcaagcccggctcggggatgcggggcgtcatcgccaagaagggcaacattcccgtcggctactacaaggacgagaagaagacggccgagacgttccggacgattaacggtgtgcgctacgccattccgggggactacgcccaagtcgaggaggacggcacggtcaccatgctgggtcgtggctcggtgtcgatcaacagcggcggcgagaaggtctaccccgaagaggtcgaggccgctttgaaggggcatcccgacgtgttcgacgctctggtggtcggggtgcccgatccgcgttacggccagcaggtggccgccgtggtgcaggcccggccgggttgtcggccgtcgttggccgagttggactcgttcgtgcgctccgagatcgcgggctacaaagtgccgcgcagtctgtggtttgtcgacgaggtgaagcgttcgcccgccggtaagccggactaccgctgggccaaggagcagaccgaggcgcggccagccgatgacgtgcatgcgggacacgtgacgagcggtgggtga

SEQ ID NO: 498 - DNA, 1065 bp, Mycobacterium Tuberculosis
atgagcgttcgcgatattgccgttgtcggcttcgcccacgccccgcacgtgcgccgcaccgacggcactaccaacggcgtcgagatgctgatgccgtgcttcgcccagctatacgacgagctgggcatcaccaaggccgacatcggattctggtgttcgggttcgtcggattacctggctggacgagcattttcgttcatctccgcgatcgactccatcggagccgtaccgccgatcaacgaatcgcacgtcgagatggacgccgcctgggcactgtatgaggcctacatcaaactgctgaccggcgaggtcgacaccgcgctggtgtacggcttcgggaagtcctcggccggaacgctgcgccgtgtgctgtcccgccagaccgacccgtacaccgtcgcgccgctgtggccggattcggtatcgatggcgggactacaggcgcggttggggctggactccggcaagtggacccacgagcagatggcgcgagtggcgttcgattccttcaccaacgctcgccgggtggattccgtggagccgccgatcaccgtcggggaactgctggcacggccgttttttgccgatccgctgcggcgccacgacattgcgccgattaccgacggtgccgccgcggtcgtgctcgcggccgacaaccgcgcccgagaactgcgcgaaaatccggcgtggatcaccggaatcgaacatcgcatcgagtctccggcgctgggggcgcgcgacatcaccgagtctccgtcgaccaaactggcggccaagatagccaccggcggacacaccggcgacatcgacgtggcggagatccatgggccctttacccaccagcacctgatcgtcgcggaggccatcaggattccgggtaagacgaaagtgaatccgtccggcggcccgttggccgccaaccccatgttcgccgccggccttgagcgtatcggctttgccgcacaacatacctgggacggatcggcgcggcgcgtgctggcgcacgccaccagcggaccggcgctgcagcaaaacctggtcgcggtcatggaaggacggggatag

SEQ ID NO: 499 - DNA, 1032 bp, Mycobacterium Tuberculosis
atggtgaagttcacacccgatagccagacgtcagttctgcgcgcgggcaagtgctcaggtactctttctccgtcgcggtcgcgattgcaaagggggagctggccggtggattccgaacgccgacgctacgggtggccgcggaatcgacgcaccttagccattactggagctgcagtcgttgtcgtggtgaccctcgcagccattggttacctgatctttgagccaaaaatttctgggtcgtccacgtccaggcaggccgcatcgccaaccactccttccccgcccagccaggtcgtggtgccgatcgacctttggaatcccgacggggtgacggtggacctggcggacgccgtttacgtggccgactccggtcacaagcgactgctgaaactgccggccggctccaacaccccgaccacgttgccattcaccgacaccatcggtccaggcggcgtggcggtaaacagcaaccgcgacgtctatgtcatcgatgaagacagccaccatgtgttgaaactcgcggccggcatcgaacccccggtcgagctcccgttcggcagccttggcgatgcgcatggtttggcagtggaccgcagcgacagcgtctatgtcgtcgactatgacaatgccaaagtgttgaaactgcccccaggcgcagatacccctaccgaactgccgttcgtcgggctcgaccacccctatgatgtggcggtggacggtgctggcaccgtctacgtgaccgacagcggccacaatcgcgtggtggcgttgaccgcggggtcggccacgccggtgcacctcccattcgccgatctcagctttcccgccggtgtgacggtggaccgcgacgatagcgtctatgtggccgatctgaacaacaatcgggtgctgaagctggcggccggctcgaatgcgcagtcgcagctgccgttcaccggactcttctccccaactgatgtggcggtggacaacgacggcgccgtctacgtgatcgacttttacaaccggatgttaaaactgccgacggcttaa

SEQ ID NO: 500 - DNA, 1155 bp, Mycobacterium Tuberculosis
atgactcggcgtcccgatcggaaagatgtggccaccgtcgacgaactgcacgcatcggctaccaaactggtgggtctcgacgattttggcaccgacgacgacaactaccgtgaggcgctgggtgtgttgctggacgcttaccagggcgaagccggcctcaccgtgttgggcagcaagatgaaccggttcttcctgcgcggtgcgctggtggccaggctactgtcccagtccgcgtggaagcagtatccggagcacgtcgacgttgccatcaaacggcctatcttcgtcaccgggttggtgcgcaccggaaccactgcgctgcaccggctgctgggcgccgacccggcccaccaaggcctgcacatgtggctggccgagtacccgcagccgcgccccccgcgcgagacctgggagtcaaacccgttgtatcgccagctcgatgcacagttcacccagcatcatgccgagaatccgggatacaccggcttgcatttcatggcggcctacgagttggaggagtgttggcagctgttgcggcagtcgctgcattcggtgtcgtacgaggcgctggcgcatgtacccagctatgccgactggttgtcacgccaggactggacgccgtcgtattgccggcaccgccgcaacctgcagctgattgggctcaacgatgccgaaaagcggtgggtactaaagaatccgagtcatctatttgccctggatgcgctgatggcgacctatcccgatgccctggtggtgcagactcaccggccggtggagacgatcatggcgtcgatgtgctcgctggcgcagcacaccacagaagggtggtcgacgaagtttgtgggcgcccagatcggtgcggacgcgatggacacctggtcgcgtgggctggagcggttcaatgccgcacgggccaaatatgattcggcccagttctacgacgtggactaccacgacttgattgccgatccgctgggtacggtggcagatatctaccggcacttcgggttgacgctgtccgacgaggctcgacaggcaatgacaaccgtccacgccgagagccagagcggtgcccgggccccaaagcattcctattcgttggctgactacgggctcacggtcgaaatggtcaaagagcggttcgccgggctgtga

SEQ ID NO: 501 - DNA, 753 bp, Mycobacterium Tuberculosis
gtgagcacccgagccgaagtgtgtgccgtcgcctgcgccgagttgttccgcgatgcaggcgaaatcatgatcagccccatgaccaacatggcctcggtaggggcgcggctggcgcggctcaccttcgcgccggacattctgctgaccgacggcgaggctcagctgctcgcggacacaccggcattgggcaagacgggcgccccaaacaggattgaggggtggatgccgttcggccgggttttcgaaaccctggcctgggggcgccggcacgtggtgatgggcgccaatcaggtcgaccgctatggcaatcagaacatctcggcgttcgggccgctgcagcggccgacccggcagatgttcggcgtccgcggctcgccgggcaacaccatcaaccacgccaccagttactgggtgggcaaccactgcaagcgggtctttgtcgaggccgtcgatgtggtctccggcatcggctacgacaaggtggatccggacaatccggccttccggttcgtcaacgtctaccgggtggtgtccaacctaggcgtgttcgacttcggcggccccgaccactccatgcgggcggtatccctacaccccggggtgacgcccggcgacgtccgcgacgccacctcgttcgaggtgcatgacctcgacgcggccgagcagaccaggctgcccaccgacgacgaactgcacctgatccgcgcggtaatcgatccgaagtcgttgcgggacagggagatacgatcatga

SEQ ID NO: 502 - DNA, 1161 bp, Mycobacterium Tuberculosis
atgacagaggcgtacgtcatcgacgccgtacggaccgcggtcggcaagcggggcggcgcactggccggtatccatcccgtcgacctgggtgccctggcctggcgcggactgctggaccggaccgacatcgaccccgccgccgtcgacgacgtgatcgccggatgtgtcgacgccatcggcggacaggcgggcaacatcgcccgactgtcgtggctggccgccggctatcccgaagaggtccccggtgtcaccgtggaccgccagtgcggatccagccagcaggcgatttcctttggcgcgcaggcgatcatgtccggcacggcggatgtcatcgtggccggcggcgtgcagaacatgagccagatcccgatctcgtcggcgatgaccgtgggcgaacagttcgggttcacctcgccgaccaacgaatccaagcaatggttacaccggtatggcgaccaggagatttcacagttccgtggctcggagctgatcgccgagaagtggaacctgtcccgtgaagagatggagcggtactcgctgaccagccacgaacgcgcgttcgcggcgatccgcgccggccacttcgaaaacgaaatcatcactgtggaaaccgaatccgggccgttccgggttgatgagggcccgcgggagtcgtcgctggagaagatggccggcttgcagccgctggtcgagggcggccggctgacggcggcgatggccagtcagatctccgacggcgccagtgcagtgttgctggcctccgagcgggccgtcaaagaccatggacttaggccccgtgcccgcatccaccacatcagtgcgcgcgccgccgacccggtattcatgctgaccggacccatccccgccacccggtacgcgctggacaagaccgggcttgccatcgacgacatcgacaccgtcgagatcaacgaggcgttcgcgccggtagttatggcctggctcaaggaaatcaaggccgacccggcgaaggtcaaccccaacggcggcgcgatcgcgctggggcatccgctaggcgccaccggcgccaaactgttcaccaccatgctgggcgagctggagcgcatcggtggccgctacgggctgcagaccatgtgcgagggcggcggcaccgccaacgtcaccattatcgagcggctgtag

SEQ ID NO: 503 - DNA, 957 bp, Mycobacterium Tuberculosis
atgaccccccctgaagaacggcagatgctacgggaaaccgtcgcctccctggtggctaagcatgccggcccggcggcggtgcgcgcagcgatggcctccgaccgcggctacgacgaatcgctgtggcggctgctatgtgagcaggtcggtgccgccgcgctggtcattccggaggagctgggcggcgcgggcggtgaactcgccgatgccgcgatcgtcgtgcaggagctgggccgggcgctggtgccttctccgctgctgggcaccacgctggcggagctggcgctgctggccgcagctaagccggatgcgcaagcactcacggagcttgcccaaggcagcgcgatcggcgcgctggtgttggaccccgactacgtggtcaacggcgacatcgccgatatcgtcgtcgccgccaccagcgggcagctgaccaggtggactcgctttagcgcgcagcccgtcgccaccatggaccccactcgccggctggcccgcctgcaatccgaagagaccgagccgctgtgccccgatcccggaatcgccgacaccgcagcaatcctgttggcggccgagcagatcggcgccgccgaacgctgcctgcagctgaccgtcgaatacgccaagagccgagtgcaattcggccgcccgatcggcagtttccaggccctcaagcatcggatggccgacctgtatgtgaccatcgccgcggcccgggccgtcgtcgccgacgcctgccacgcgcccacacccaccaacgccgccaccgcgcggctggccgccagcgaggcgttgagcaccgcggcggccgagggcatccaactgcacggcggcatcgcgatcacctgggaacacgacatgcacctgtatttcaaacgagcgcacggcagtgcacaattgctcgagtcgccacgagaggtgctgcgccgtttggaatctgaggtgtgggagtcgccgtga

SEQ ID NO: 504 - DNA, 828 bp, Mycobacterium Tuberculosis
gtgggatggatcggcgatccgatttggctcgaggaggtgctacggccggcactcggcgagcgcctgcgggtgctcgacggctggcgggaacgcggacacggcgactttcgcgatatccgcggtgtgatgtggcaccacaccggcaactcacgtgagaccgccaaaagcattgcccgcggccggcccgacttacccggcccgctggccaatctgcacatcgcgcacagcggggtcgtaacgatcgtcgcggtaggcgtgtgctggcacgccggccgcggcagctacccgtggctgccaaccgacaacgccaactggcacatgattggcgtcgagtgcgcgtggccgaccatccggcgtgacggctcctacgacgccggtgagcgctggcctgacgcgcagatcgtgagcatgcgagacgtcgccgcggcgctcacgctcaagctcggctacgggcccgaacgcaatattgggcacaaagagtatgccggggcggctcaaggcaaatgggacccgggaaacctgtcgatggactggtttcgcgccgaggtggcaaaggacacgcggggcgagttcgaccaccccctcaccccgccgccggcggtgattgcccgcccaccgattctgcccaagccgcgcaacccgcgtgacgatcgcatcctgctcgaggaggtgtgggaccagctacgcggcatcgagggccgcggctggccggtactcggcgacaagacgatcgtcgactacctagccgagctcggcaataaggtcgacgccctggccgcaaaactcgacgcgcgcgagggcctcgaccggcccagtgacactcggtag

SEQ ID NO: 505 - DNA, 420 bp, Mycobacterium Tuberculosis
atgttacggacgatgctgaagtcgaagatccaccgcgccacggtgacctgcgccgacctgcactacgtcggctcggtgaccatcgatgccgacttgatggacgccgccgacctgctggaaggcgaacaggtaaccatcgtcgatatcgacaacggtgctcgactggtcacctacgcgatcaccggcgaacgcggcagtggtgtgattggcatcaacggtgccgccgcgcacttggtgcatccgggggatctggtgattctgattgcgtacgcgacgatggacgacgcccgggcccgcacataccagccgcggatcgtgtttgtcgacgcttacaacaaaccgatcgacatgggccacgatccggcatttgtgcccgaaaacgcgggcgagctgctagacccccggctcggtgtgggatag

SEQ ID NO: 506 - DNA, 567 bp, Mycobacterium Tuberculosis
atgacgcgggtagtgctctcggttggctccaacctgggtgaccgcctggcacgattgcggtcggtcgccgacggtctcggcgatgcgttgattgcggcttccccgatatatgaggccgacccctggggtggggtggagcaggggcagttcctcaatgcggtgctgatcgccgacgatcctacctgcgaaccgcgggagtggctgcggcgggcgcaggagttcgagcgcgctgcgggcagggtgcgtggccagcgctggggtccacgaaatctcgacgtcgacctgatcgcctgctaccagacctcggccaccgaggctctggtcgaagtgaccgcgcgggagaaccacctcacgctgccgcacccactggcgcatctgcgggcctttgtgttgatcccgtggattgccgtcgacccaacggcgcagctgacggttgccgggtgcccgcggcccgtcacgcgactgctggccgagctggagcccgccgaccgcgacagtgtgcggttgtttaggccgtcgttcgatctgaatagcagacaccccgtcagtcgggcaccggaaagctga

SEQ ID NO: 507 - DNA, 843 bp, Mycobacterium Tuberculosis
gtgagtccggcgcccgtgcaggtgatgggggttctaaacgtcacggacgactctttctcggacggcgggtgttatctcgatctcgacgatgcggtgaagcacggtctggcgatggcagccgcaggtgcgggcatcgtcgacgtcggtggtgagtcgagccggcccggtgccactcgggttgacccggcggtggagacgtctcgtgtcatacccgtcgtcaaagagcttgcagcacaaggcatcaccgtcagcatcgataccatgcgcgcggatgtcgctcgggcggcgttgcagaacggtgcccagatggtcaacgacgtgtcgggtgggcgggccgatccggcgatggggccgctgttggccgaggccgatgtgccgtgggtgttgatgcactggcgggcggtatcggccgataccccgcatgtgcctgtgcgctacggcaacgtggtggccgaggtccgtgccgacctgctggccagcgtcgccgacgcggtggccgcaggcgtcgacccggcaaggctggtgctcgatcccgggcttggattcgccaagacggcgcaacataattgggcgatcttgcatgcccttccggaactggtcgcgaccggaatcccagtgctggtgggtgcttcgcgcaagcgcttcctcggtgcgttgttggccgggcccgacggcgtgatgcggccaaccgatgggcgtgacaccgcgacggcggtgatttccgcgctggccgcactgcacggggcctggggtgtgcgggtgcatgatgtgcgggcctcggtcgatgccatcaaggtggtcgaagcgtggatgggagcggaaaggatagaacgcgatggctga

SEQ ID NO: 508 - DNA, 312 bp, Mycobacterium Tuberculosis
atgacggaaaacttgaccgtccagcccgagcgtctcggtgtactggcgtcgcaccatgacaacgcggcggtcgatgcctcctcgggcgtcgaagctgccgctggcctaggcgaatctgtggcgatcactcacggtccgtactgctcacagttcaacgacacgttaaatgtgtacttgactgcccacaatgccctgggctcgtccttgcatacggccggtgtcgatctcgccaaaagtcttcgaattgcggcgaagatatatagcgaggccgacgaagcgtggcgcaaggctatcgacgggttgtttacctga

SEQ ID NO: 509 - DNA, 1179 bp, Mycobacterium Tuberculosis
atgagcagagcgttcatcatcgatccaacgatcagtgccattgacggcttgtacgaccttctggggattggaatacccaaccaagggggtatcctttactcctcactagagtacttcgaaaaagccctggaggagctggcagcagcgtttccgggtgatggctggttaggttcggccgcggacaaatacgccggcaaaaaccgcaaccacgtgaattttttccaggaactggcagacctcgatcgtcagctcatcagcctgatccacgaccaggccaacgcggtccagacgacccgcgacatcctggagggcgccaagaaaggtctcgagttcgtgcgcccggtggctgtggacctgacctacatcccggtcgtcgggcacgccctatcggccgccttccaggcgccgttttgcgcgggcgcgatggccgtagtgggcggcgcgcttgcctacttggtcgtgaaaacgctgatcaacgcgactcaactcctcaaattgcttgccaaattggcggagttggtcgcggccgccattgcggacatcatttcggatgtggcggacatcatcaagggcaccctcggagaagtgtgggagttcatcacaaacgcgctcaacggcctgaaagagctttgggacaagctcacggggtgggtgaccggactgttctctcgagggtggtcgaacctggagtccttctttgcgggcgtccccggcttgaccggcgcgaccagcggcttgtcgcaagtgactggcttgttcggtgcggccggtctgtccgcatcgtcgggcttggctcacgcggatagcctggcgagctcagccagcttgcccgccctggccggcattgggggcgggtccggttttgggggcttgccgagcctggctcaggtccatgccgcctcaactcggcaggcgctacggccccgagctgatggcccggtcggcgccgctgccgagcaggtcggcgggcagtcgcagctggtctccgcgcagggttcccaaggtatgggcggacccgtaggcatgggcggcatgcacccctcttcgggggcgtcgaaagggacgacgacgaagaagtactcggaaggcgcggcggcgggcactgaagacgccgagcgcgcgccagtcgaagctgacgcgggcggtgggcaaaaggtgctggtacgaaacgtcgtctaa

SEQ ID NO: 510 - DNA, 297 bp, Mycobacterium Tuberculosis
atgacctcgcgttttatgacggatccgcacgcgatgcgggacatggcgggccgttttgaggtgcacgcccagacggtggaggacgaggctcgccggatgtgggcgtccgcgcaaaacatttccggcgcgggctggagtggcatggccgaggcgacctcgctagacaccatgacccagatgaatcaggcgtttcgcaacatcgtgaacatgctgcacggggtgcgtgacgggctggttcgcgacgccaacaactacgaacagcaagagcaggcctcccagcagatcctcagcagctga

SEQ ID NO: 511 - DNA, 972 bp, Mycobacterium Tuberculosis
atggatcgacagagtgctgtagcgcagctgcgtgcggctgcggagcagttcgctcgggtccatctcgacgcctgcgaccgttggagcgtggggctctccggcggcccggactcgttggcgctcaccgctgtagccgcacggctgtggcccaccaccgcactgatcgtggaccacggtctgcagcccggctcggccacggtcgcggaaacagctcgcatacaagcgatttcgctgggatgtgtggacgcgcgggtgctttgcgttcaggtgggcgcggccggcggccgggaggcggcggcgcgcagcgcccgctactcggcattggaggagcaccgcgatggcccggtgctgttggcccatacgctcgatgatcaggccgagacagtgttgttggggcttggccgtggttcgggggcccggtcgatcgccggcatgcgtccgtacgatccgccctggtgccggccgctgctgggggtgcgccgcagcgtgacacatgcggcctgccgggagctgggcctgaccgcctggcaggatccgcacaacaccgaccgccgcttcacccgaacccgattgcgcaccgaagtgctgccactgctggaggacgtgctgggcggaggtgtggccgaagcgctggctcgcaccgcgacagcgttgcgcgaggacactgacctcatcgacacgatcgctgcgcaggcgctgcccggagccgctgttgctggctcacggggacaggagttgagtaccagcgccttgaccgcgctgccggatgcggtgcggcgccgggtgattcggggctggctgctggccggcggcgcgaccggactgaccgacaggcagatccgcggagtggaccggctggtcaccgcgtggcgcggtcagggcggggtagcggttgggtccacgttgcgcggtcagcgactggtcgccgggcggcgcgacggcgtacttgtgttgcggcgcgagcccgtttga

SEQ ID NO: 512 - DNA, 1386 bp, Mycobacterium Tuberculosis
atgggtcccacacgctggcggaaatccacgcacgtggtcgtcggcgcggccgtgctggcgtttgtcgccgttgtggtggcggccgcagcgctggtcactactggtggtcaccgggctggcgtgcgcgcacctgcgcctccaccgcggccacccacagtcaaggcgggagtggtccctgtggcggacaccgctgcgacaccgagtgccgctggcgtgaccgcggcgcttgcggtggtggcggccgatcctgatctgggcaagttagcaggtcggatcaccgatgccctgaccggacaagaactttggcagcggctagacgacgtgcccttggtgccggcttcgaccaacaaaatcctgacggcggcggcggctctgctgacactggaccgacaggcccggatcagcacgcgggtggtggccggcggccagaacccccagggacctgtcgtgttggtgggcgcgggcgatccgacgctgtcggcagcgccgcccggtcaggacacctggtatcacggcgcggctcgcatcggtgacctcgtcgaacaaattcgccgcagcggtgtgacgcccaccgccgtgcaggtggacgcttcggcgtttagcggtccgacgatggcgccgggttgggatccggccgatatcgacaacggtgacatcgcgccgatcgaagcggcgatgatcgacgccgggcgtatccagccgaccaccgtcaattcgagacggtcccgcaccccggcgctggatgccggtcgggagttggccaaagcccttggcctggaccccgcggcggtgacgatcgcatcggctccggccggcgcgcggcagctggccgtggtgcagtcggcgccgttgatccagcgactgtctcagatgatgaacgcctccgacaatgtgatggccgagtgcatcggccgcgaggtagcggtcgcgatcaaccggccgcagagctttagtggcgcggtcgacgcggtgaccagccgattgaacaccgcacacatcgacaccgccggcgctgcgctggtggattctagtggattgtcgctcgacaaccgcctgaccgctcggacgctcgatgcaacgatgcaggccgcggctggacccgaccagcccgcgttgcggccgctgctggatctgctaccgatcgccggtggcagtggcacgctgggcgagcgcttcctcgacgcggccaccgaccagggtccggccgggtggttgcgggccaagaccggctcgctgaccgcgatcaactcgctagtcggggtgctcaccgaccgtagcggccgagtgctcaccttcgcgttcatctccaacgaagccggtcccaacggtcgcaacgcgatggacgctctggccactaagttgtggttctgcgggtgcacgacgtga

SEQ ID NO: 513 - DNA, 489 bp, Mycobacterium Tuberculosis
gtgcaattcgacgtgaccatcgaaattcccaagggccagcgcaacaaatacgaggtcgaccatgagacggggcgggttcgtctggaccggtacctgtacaccccgatggcctacccgaccgactacggcttcatcgaggacaccctaggtgacgatggcgacccgctggacgcgctggtgctgctaccgcagccggtcttccccggggtgctggtggcggcgcggccggtggggatgttccggatggtcgacgagcacggcggcgacgacaaagtgctgtgcgtcccagccggtgacccccggtgggaccacgtccaagacatcggggacgttccggctttcgagctggatgcgatcaagcatttctttgtgcactacaaggacctggaaccaggtaagttcgtcaaggcggccgactgggtcgaccgcgccgaagccgaggcagaggtgcagcgttcagtggagcgcttcaaggccggtacacactga

SEQ ID NO: 514 - DNA, 636 bp, Mycobacterium Tuberculosis
gtgccgcatccatgggacaccggcgatcacgaacggaattggcagggctacttcatccccgctatgtccgtcttgaggaaccgggtcggcgctcgaacgcatgccgaactgcgtgatgccgagaacgacctcgttgaggcccgggtgatcgaactccgcgaggatcccaatctgctgggcgaccgcacagatctcgcatacctgcgggcgattcaccgccagctgttccaggacatttacgtctgggcgggagatctgcggacagtcggcatcgagaaggaggacgagtctttctgcgcgccgggcggcatcagtcggcccatggagcatgtggctgcggagatctaccagctcgaccggctcagagcggtcggcgaaggtgatctcgctggccaggtcgcataccggtacgactacgtgaactatgcccacccgttccgcgagggcaacggccgctcgacccgcgagttcttcgatctcctgttgtccgaacgcggttctggcctcgactgggggaagaccgacctggaagagttgcacggcgcttgtcacgtggcgcgcgccaactctgatctcacgggcctggtcgcgatgttcaaggggatcctcgacgccgagcccacttacgacttctga

SEQ ID NO: 515 - DNA, 285 bp, Mycobacterium Tuberculosis
gtgtcgtttgtgatcgcggcgccggaggcgttggactcggcagcaacggacctcgtggtcctgggctcgacgttaggcgcggccactgcggccgcggcggcccagacgacgggtatcgtggccgcggcccacgacgaggtgtcggcggcgatcgcagccctgttttccgcccacggccaggcctatcaggccgccagcgcgcaggccgcggcgtttcacacccggttcatccgtgcgcgctcccgacatccgcagcaggaaacgacctgtcgccgtgtgcgatag

SEQ ID NO: 516 - DNA, 588 bp, Mycobacterium Tuberculosis
ttgctgaatgcgcccactcaggcgctgttggggcgtccgttggtgggcaatggcgccaatggggccccggggactggggcaaacggcggcgatggcgggattttgttcgggtccgggggggccggcgggtccggagcggccggcatggcgggtggcaacggcggggccgccgggctgttcggcaacggcggagccggcggagccggcggcagcgcgacggccggtgcggccggggcgggcgggaacggcggggccggcgggctgctgttcggtaccgccggggccggcggcaacggcgggttaagcctcggtttgggcgtcgccggcggcgccggcggcgccggcgggtcgggcggtagtgacaccgccggacacggggggaccggtggtgccggcggcctgctattcggcgccggcgaggacggcacaacgcccggtggcaacggtggggcgggcggtgtcgccgggctgttcggcgacggcggcaacggtggtaacgccggagttggcacgcccgcgggcaacgtcggcgccggcggcaccggcggcctgctgctcggccaggacggcatgaccgggttgacgtag

SEQ ID NO: 517 - DNA, 519 bp, Mycobacterium Tuberculosis
gtgagcaagatcgatcgcaagaacggtgtgcccagcacgctgaccacgattccgttggccgacccgcacgccggacctgctgagccgtcgatcggtgacctgatcaaagacgcgacaacgcagatgtcgacgctggtccgagccgaggtcgagctggcccgcgccgagatcacccgggacgtcaagaagggactgaccggcagtgttttcttcatctcctcgctggtggtcgggttctactccaccttctttttcttctttttcgtcgccgaactgctcgatacctggatctggcgctgggtggctttcttgctcgtgttcgccataatggtcgtggtcaccgccgtgttggccctcttgggtttcctgaaagtccggcgcatccggggaccgcggcagaccattgcgtcggtcaaagagacgcgcaccgcacttaccccgggccatgacaaaacccctgtgacaccaaaacccgtgacatctgatcgcgcgacgccggttgacccctcgggttggtag

SEQ ID NO: 518 - DNA, 738 bp, Mycobacterium Tuberculosis
gtgcccgggcgctggtctgcagaaacccggctcgccttggtgcgacgggcgcggcgaatgaatcgcgctttggcacaggcatttccgcacgtatactgcgagctggacttcaccacgccgctcgagctagccgtggcaaccatactttcggcgcagagcaccgacaaacgggtgaatttgacgacgccagccttgttcgcgcggtatcggacggcacgggactacgcccaggcggatcgcaccgagctcgagagcctcatccgccccaccggcttctaccgcaacaaagcggcctctctcatcggcctggggcaggccctagttgagcggtttggcggtgaggtgccggccaccatggacaagttggtgacgctgcccggggtggggcgcaaaaccgccaatgtcatcctgggtaacgcattcggtatccccggaatcacggtggatactcatttcggacgattggtgcgccggtggcgctggaccaccgcagaggacccggtcaaggtggagcaggcggtcggtgagctgatcgaacgcaaggagtggaccttgctcagccaccgagtgatctttcacggacggcgggtgtgccacgcccgcagaccggcgtgtggtgtttgtgtgcttgccaaagactgcccctccttcgggcttggccccactgaaccgctgctcgcggcgcccctggtccagggccccgagaccgatcacctgctggccctggctggactgtaa

SEQ ID NO: 519 - DNA, 378 bp, Mycobacterium Tuberculosis
atgtttactctccttgtgtcatggttgctcgtggcctgcgttcctgggttgttgatgctggcgaccctcgggttgggacggctggaaaggtttctggcccgagacacggtcacggcgaccgacgtcgcggagtttctcgagcaggccgaggccgtggatgtgcatacgctcgctcggaatggaatgccggaggcgctggattacctgcatcgacgtcaagcccggcgaatcaccgattcaccgccgcttgggtctggcgctgggccacggtatgccgggccgctgtttgtcaccgatctcgatagccccgtcgagccaccccggcatggccagcccaatccgcagtttagaacggctcgacacgcaaatcacgtgtag

SEQ ID NO: 520 - DNA, 1161 bp, Mycobacterium Tuberculosis
atgagtgtcacaccgaagaccctcgatatgggcgcaatcctggccgacacatccaaccgggtggttgtgtgctgcggcgccggtggggtcggcaagaccactaccgcggccgcgctggcgttgcgcgcggccgagtatggccgcactgtggtcgttttgacgattgacccagccaagcgattggcacaagcactggggatcaacgatcttggcaacacaccacaacgcgtgccattggcacccgaggttcccggcgagctacacgcgatgatgctcgacatgcgccgcacgtttgacgaaatggttatgcaatactctggacccgaacgggcgcaatcgattctggacaaccagttctatcagaccgtcgccacatcgcttgccggcacccaagagtacatggctatggagaagctgggccaactgctaagccaggaccgctgggacctgattgtggtagacactccgccgtcgcgtaacgcgctggacttcttagacgcgccaaagcgactgggcagcttcatggatagtcggctgtggaggctgttactcgctcccggccggggcatcgggcggctgatcaccggcgtgatgggattggccatgaaggcgttgtccaccgtgctcggttcccagatgctggccgacgcagcagcgttcgttcaatcgctggacgccacgttcggtggtttccgcgagaaggcagaccgcacttacgcgttgttgaaacggcgcggcacccagttcgtggtggtgtcggcggccgaacccgacgcactgcgcgaggcgtccttcttcgtcgaccggctatcgcaggagagcatgccgctagcggggctggtcttcaaccgcacgcacccgatgctgtgcgcattgccgatcgagcgggcaatcgacgccgccgaaacgttggatgccgagaccaccgactccgacgccacatcgctggccgcagcggtgctgcgtatccatgccgagcgcgggcagacagccaaacgggagatccggctgctgtcccggttcaccggagccaaccccaccgtgccggtcgttggggtaccgtcgctcccgtttgacgtctctgacctggaagcgctgcgggcgctcgccgaccagctcaccacggtcggcaacgatgcgggccgcgcagcgggccgctga

SEQ ID NO: 521 - DNA, 933 bp, Mycobacterium Tuberculosis
atgtcggaggtggtgaccggcgacgccgtggtgctcgacgtacagatcgcccagttgccggtgcgcgcggtcagcgcggtcatcgatatcaccataatattcatcggctacatcctcggtctgatgctgtgggcgaccgccctgacccagttcgacgaagccttgaccaccgcattcctgatcatcttcacggtgctggcgctggtcggctatcccctggtctgggaaaccgcaacgcggggccgatcagtggggaagatcgtgatgggtctgcgggtggtgtcagacgacggtggcccggagcggttccggcaggcgctgtttcgcgcgttagcgtcggtggtggagatctggatgctgctcgggagccccgccgtgatctgcagcatgttgtcgccaaaagccaagcgagtcggcgacgtcttcgcgggcacggtcgttgtcagcgaacgtggtccgcggttggggccgccgccggtgatgccaccgtcgctggcctggtgggcgtcgtcgctgcaattgtctgggcttaccgccggccaagccgaggttgcacgtcaatttctggtgcgggcaccgcaactcgatcctgcgctacgcgagcagatggcctaccggatcgccggtgatgtggttgcccgcatcgctccgccgccgccacccggagttccaccacagttggtcctggccgccgtcctcgccgaacgacaccggcgtgaactgttgcgactgcgtcccacgctgcctcccgcaggacaggcgccatgggcccaaatggcgcctcatcggggttggccgcccggtttgtccggcgccacgccgtggtctcctcagcagccggtgatcccctggccggagccagatccgccaccgcaagccgctccctggccgcagcaggcgccggacggcccgggattctcgccgccgggctag

SEQ ID NO: 522 - DNA, 966 bp, Mycobacterium Tuberculosis
atgagagtgtcggttgccaaccatctgggcgaggatgcggggcatctggcgttgcgccgcgatgtgtactctggcctgcagaagacaccgaaatcgttaccgcccaagtggttttacgacacggtgggtagtgaactgttcgatcagatcacccggttgccggagtactacccgacccgagccgaggccgaaatcctacgggccagatcggccgaagtggcttccgcctgccgggccgatactttggtcgagttgggtagcggcacctcggagaagacccggatgctgctggatgcgttgcgccaccggggatcgctgcgcagattcgtcccgttcgacgtcgacgccagcgtgctgtcggcaactgcgaccgcaattcagcgtgaatacagtggtgtcgaaatcaacgctgtttgtggggatttcgaggagcatttaaccgagattcccaggggaggacggcgcctgtttgtgttcttggggtccacgatcggcaacctcacgcccgggccgcgcgcgcagttcctgacggccctggccggggtaatgcggccgggcgatagcctgctgctgggcaccgacctggtcaaggacgcggcccggctggtgcgcgcctacgacgatcctggcggggtgacggctcagttcaatcgcaacgtgcttgccgtgatcaaccgggaactcgaagcggatttcgacgtcgatgccttccagcacgtcgcccgttggaacagcgcagaagagcggattgagatgtggttgcgtgccgacggtcgccagcgggtacgggtcggtgcactggacctgaccgtcgacttcgacgccggggaggagatgttgaccgaggtctcgtgcaagttccggccgcaagcggtcggtgccgagttggccgcggccggactgcatcgcatccgatggtggaccgatgaagccggtgactttggcctgtcgctggccgccaagtga

SEQ ID NO: 523 - DNA, 321 bp, Mycobacterium Tuberculosis
atgcgacacatgagtgaaacatctgaaaccccaacaccaccgcctcaccagacccccaaggtgttcaaagccgcggcgtgggtagccattgccgccggaaccgtgttcatcgtggcggtcatcttcttcaccggctatatcctcggcaagcatgccggtcacggcggcttccaccaccggcaacaccaccagcacccggcgatgatgctgcgaccgggcagtccgcacggtgggcccgcggcagtgcgtcccggcccaggcccgggcgggcccggccaggtgccgtcgtccgtcagtcctcccgcgacacccgctccgtaa

SEQ ID NO: 524 - DNA, 891 bp, Mycobacterium Tuberculosis
atgttgatctcacggatgtcggtgcggagtgccagcatgtccgtcatgggtgacgtcttcatcggcagcgaggccatcaccgctggtcgcctgaccaggcacgagctgcaacgttggtatcagccgatgttccgcggtgtgtacgtctcgaggcgctcagtgcccacactttgggatcgcacggttggcgcctggctagccacgaggcgccatggcgtcatagctggtaatgcggcctctgcgctgcatggtgctcagtgggtggacgtcgacgtggccatcgagctgatttctcccactacccgcccgcagcacggtcttgtcatacgtcgtgagaccttgtgcgacgacgagatcaccagggtggtgggcctgccggtcaccacactggcgcggacggcatacgacctcggccgccatctgtcccgcggcgaagccgtggctcgtctcgatgccctcatgcgtgccaccccgttttcccgcgacgacgtgcttctattggccaagcgtcacgcgggcgcccgaggtgtccgccggttgcgtgacgtgctgccccttgttgatggcggcgccgcgtcgcccaaggagacctggctgcggctgttgttgatcgacgccggcctgccagtccccacgacgcaaattccggtggtccaccgctggcgcaacgttggcgtgctcgacatgggctgggagaaatacatggtggccgccgagtacgacggtgatcagcatcgcagcgaccgcggtcgctacgtgaaagaccagcggcggctccgcaagctggccgagttgggctggatcgtcattcgcgtgatcgccgaggacaaccccgacgacgtggtgaaccgcgtgcgtgccgctctgctggccaggggatggcggccctaa

SEQ ID NO: 525 - DNA, 444 bp, Mycobacterium Tuberculosis
atgggacaggtgagcgcagccagcacgatcttgatcaatgctgagcccacggccacactcgacgcgctggccgactatgagaccgtccgtcctaaaatcctgtccccgcactacagcgagtaccaggtgctcgagggcggcaaggggcggggcacagtcgccaagtggcggctgcaggcgacgcagtcgcgtgttcgcgatgtgcaggtgaacgtggacgttgccgggcacaccgtcatcgagaaggacatgaattcgtccatggtcaccaactggacggtcgctcccgccggacccggttccagcgtcacggtgaagaccacctggaccggcgcgggcggggtcaagggtttcttcgagaagacctttgcgccgctagggctgaagaagatccaggccgaggtgctgtccaacctcaagaccgaactcgagggtgacgcctga

SEQ ID NO: 526 - DNA, 930 bp, Mycobacterium Tuberculosis
atgcagaatgccaccatgcgcgttctggtcaccggcggtacgggatttgtgggcgggtggactgccaaagccatcgctgacgcgggccactccgtccggttcctggtgcgaaatcccgcacggctgaagacgtctgtcgcgaaactgggcgtcgacgtgtcggactttgcggttgcagacatatccgaccgcgattcggtacgggaggcgttgaacggatgcgacgccgtcgtgcacagcgccgcgctggtggcaaccgacccgcgtgagacttcgcggatgctgagtacgaacatggcgggcgcccaaaatgttctcggtcaagccgtcgagctcggaatggatccgatcgtgcatgtgtcgagcttcacggcgctgtttcgtcccaacttggcgacgctgagcgctgatctgccggttgccggtgggacggatggatacggacaatccaaagcgcagatcgaaatctatgcgcgcggtcttcaggacgccggcgcaccggtgaacatcacttatcctggcatggtcctcggcccgccggtgggcgatcaattcggtgaagccggggagggtgtccggtccgcattgtggatgcatgtcattcccgggcgcggcgcggcgtggttgatcgtcgacgtccgagatgtggcggcactgcacgcggcgttgttggaatccgggcgtgggccgcgccgctacactgcgggaggtcatcggattccggtgcccgagctcgcgaaaattctgggcgggtcgccggcaccacgatgctggccgtcccggtgcccgattccgcgctgcgtgtcgcgggatcggtgctggatcaagccgggccctatctgcctttcaatactccgttcaccgcggcaggtatgcagtactacacacagatgccggagtccgacgattcgccgagcgaaaaagaactag

SEQ ID NO: 527 - DNA, 480 bp, Mycobacterium Tuberculosis
gtgaagcgtggactgacggtcgcggtagccggagccgccattctggtcgcaggtctttccggatgttcaagcaacaagtcgactacaggaagcggtgagaccacgaccgcggcaggcacgacggcaagccccggcgccgcctccgggccgaaggtcgtcatcgacggtaaggaccagaacgtcaccggctccgtggtgtgcacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgcctcggcaaccaaggacggcagccactacaagatcactgggaccgctaccggggtcgacatggccaacccgatgtcaccggtgaacaagtcgttcgaaatcgaggtgacctgttcctaa

SEQ ID NO: 528 - DNA, 987 bp, Mycobacterium Tuberculosis
gtgaccatcatgcgtgccgtcgtcgccgaatcctcagatcgactggtatggcaggaagtccccgacgtgtcggctgggccgggcgaagtgctcatcaaggttgccgcttccggtgtcaaccgcgccgacgtgctacaggccgccggcaaatatccgccgcccccgggagtaagcgacatcatcggcctagaggtgagcggcatcgtcgctgcggtcggtcccggggttaccgaatggtctgccggacaagaggtttgcgccttgcttgccggcggcggctatgccgaatacgttgccgttccggccgaccaggtgctgccgattccgccgagcgtcaacctggtcgactcagccgccctgcccgaagtggcgtgcacggtgtggtcgaacctggtgatgaccgctcatctgcggccgggtcagctggtgctgattcacggcggggccagcggcatcggcagccacgcgatccaggtggtccgcgccctggcagcacgggtggcgatcaccgccggctcaccggagaaactggagctctgtcgcgacctgggcgcccaaatcaccatcaactaccgcgacgaggatttcgtcgcgcggctgaagcaagagaccgatggtagcggcgctgacatcatcctcgacatcatgggagcgtcctacctggaccgcaatatcgacgcgctggccaccgacggccagctgatagtcattggcatgcagggcggggtgaaggccgagctcaacctgggcaagctgctcaccaagcgggcgcgcgtcatcggtaccacgctgcgggcccggccggtcagcggcccgcacggcaaggcggccatcgcccaggcggtggcggcctcggtctggccgatgatcgccgcgaaccgggtccggcccgtcatcggcacccggctgcccatccaacaggcggcacaagcgcatgaactgatgttgtcgggcaagacgttcggaaagattctgctgacggtatag

SEQ ID NO: 529 - DNA, 2001 bp, Mycobacterium Tuberculosis
gtgggcctgtggttcggtacgctaatcgctttgattttgctgatagcgccgggggcaatggttgctcgcatcgcccagctgaggtggccggtcgccatcgcggttggcccggcgctgacatacggcgtggtggcactcgcgatcatcccctatggcgcgctcggaattccctggaacggttggaccgcgctggccgccttggcggtgacgtgcgctgtagcgaccggtttgcagctactgcttgcccgttttcgggacctcgacgccgaggcacttgcggttagccgctggcccgcggttacggtcgccgccggggtgctgctgggcgccctgttgatcggatgggccgcatatcgcggcataccgcactggcagtccatccccagcacctgggacgcggtctggcacgccaacaccgtacgtttcatcctggacaccggccaggcgtcctcgactcacatgggggagcttcgcaacgtcgagacccatgccccgttgtactacccgtcggtgttccacgggctggtcgcggtgttctgccagttaaccggcgcggcacccaccaccggctacacactgagttcgctggccgcctcggtctggctgtttccggtcagtgcagccgttctcacctggcgcgcggtgcgctcacacccgggcgcgctgtggtcggcctcctgcgcctcggcagagtggcgcgccgccggagcggcgggcaccgccgcggcactctcggcgtcgttcaccgcggtgccctacgtcgagttcgataccgccgctatgcccaacctggcggcctacggcatcgcggtgccgacgatggtgctgatcacctcgacattgcggcaccgcgaccgcatcccggtggccgtgctagcgctggtcggcgtcttctcactgcacattaccggcggtatcgtcgtagcgctgttggtgtcggcctggtggcttttcgaggcactgcggcatcctgtgcgatcaaggctggccgacctgttgacgctggccggcgtggcagcgatggccgggttggtcatgttgccgcagttcttgagcgtcaggcagcaggaagacatcatcgccggacacgcttttcccacctatctcagcaagaagcgtgggctgttcgacgctgttttccagcactcccgccatctcaacgacttcccggtccagtacgcgctcattgtgttggccgccatcggcgggctcattctgctggtcaagaagatctggtggccgctggcggtttggctgctgttgattgtgatgaacgtcgacgcgggaacaccgttgggcggacctatcggaggggtggccggcgcactcggcgagttcttctatcacgatccgcgccgcatcgcggcggccacaaccctgctgttgatgctgatggcaggtgtggcgctgttcgcgacagtcatgttgctagtggccgcggcgaaacgactgaccgaccgtttcagaccccagccggtgtctgtctgggcatcggcgaccgcgacactactgatcggagccactctggtcagtgcgtggcattactttccccggcaccgatttctgttcggcgacaagtacgactcggtgatgatcgaccagaaagatctcgacgccatggcatacctggcgagtttgcccggcgcacgcgacacgttgattggcaacgccaacacggacggcaccgcgtggatgtatgccgtggccggcctacacccgctgtggacccactacgactacccgctgcaacagggcccgggctatcaccggttcatcttctgggcctatggccgcaacggggagagcgatcctcgggtactcgaggccatccaagtcctccgtatccgctatatcctgaccagcactccgacggtgcgggggtttgccgtgccggacggactagtgtcgttagagacatcgaggtcgtgggcgaagatctacgacaacggcgaggcccgaatctacgaatggcgcggcactgccgcagcaacacactcctag

SEQ ID NO: 530 - DNA, 1224 bp, Mycobacterium Tuberculosis
atgcggattctggcgatgacgcgtgcgcacaacgccgggcggacactagccgcaacgttggactcgttggccgtgttcagcgacgacatctacgtgatcgacgaccgcagcaccgatgacaccgccgagatcctggcgaaccatcctgcggtgacgaacgtggtgcgggcccgaccagatctgccgcccacgccatggctgattcctgagtccgccgggctggaactgctgtatcggatggcggacttctgccgcccggactgggtgatgatggtcgatgccgattggttggtcgagaccgacatcgatcttcgggcggtgttagcccgcacaccggacgacatcgtggcgctgatgtgtccgatggtgtcacgctgggatgatccggagtatcccgacctgattccggtgatgggaaccgccgaagcgctacgtggaccgttgtggcgctggtacccgggtctgcgggcaggcggcaagctgatgcacaacccgcattggccggccaacatcaccgatcacggtcgcatcggacagcttccgggggttcggctggtgcatagcggctggtcgacgctggcggaacggatcttgagggtggagcactatctgcggctcgatccggactatcggttcaacttcggggtggcctacgaccgatctttgttgtttggctacgcactcgacgaggtcgacctgctcaaagccgactaccggcggcgcatccgcggcgacttcgatccgctcgagccgggcgggcggctgccgatcgaccgggagccgcgcgcgatcggccgcgggtacggtccgcacgcgggtggtttccatcccggtgtcgacttcgccaccgatccgggaacacccgtctacgcggtcgcttccggggccgtcagcgcgatcgacgaggtcgatggcctggtgtcgctgacgatcgcacgctgcgagctcgacgttgtctatgtatttcggcccggggacgagggccgccttgtccttggtgatcgaatcgccgcgggagcgcaactgggcaccatcggtgcgcaaggcgaatcggcagatggttatctgcatttcgaggtccgcacgcaggacgggcatgtcaatccggtgcggtacctagccaacatgggactacggccgtggccgccaccgggacggttgcgagccgtatcgggcagctacccgccggccacgccatgcaccatcaccgccgaggatcggtag

SEQ ID NO: 531 - DNA, 1782 bp, Mycobacterium Tuberculosis
atgcccgagtacgacctagaggccgtggacaagctgcccttctcgacccctgaaaaggcgcagcgctaccaaacggaaaactatcgcggggccatgggcctcaactggtacctcacggatccgaccctgcagttcatcatggcctattacctacgacccgatgaattggcgttcgcagaaccccatctgacccgcattggtgagctgacgggggggccagtgacgcgttgggccgaggaaaccgaccgcaaccccccgcggctcgaacgctacgaccggtgggggcatgacatcagccgggtagtgctgccggaatcgttcatccaatccaagcgcgccgtcatcgaggcgcgacaagccgtgcgcgacgacgcggcacgggccggcgtcaagccgtcgctggcactcttcgccgccgactatctgctcaaccaggccgatatcggtatggcttgcgcgctcgccactggcggcaacatggtccggtcgctggtgactgcctacgcgccacccgatgtgcgcgaattcgtcctaggcaaactcaattccggcgagtgggacggcgaggccgcgcagctgctgacggagcgtgcgggcggctccgatctgggagctctggagacgacggccacccgcagcggcgacgtgtggctgctgaacggcttcaagtggtttgcgtccaactgcgccggggaggcgttcgtggtgttggccaagcccgagggggcgcctgactcgactcgaggtgtggccaccttcctcgtgctacggacgcgccgtgacggttcccgcaacggcgtgcgtatccgtcggctgaaggacaagctcggcacccgctctgtcgcctccggtgaaatcgagttcgtcgacgccgaagcctttctgttgtccggcgaaccgagcgctgacgcgggcccgtccgacggcaagggactcacccgcatgatggagctgaccaacagattgcggttgggcaccgcctcgttcgccctcggcaacgcgcgccgcgcgctggtcgaatcgctgtgctacgccgggcagcggcgggcattcggtggggcgctcatcgacaagccgctgatgcgccgcaagctggccgaaatggtcgttgatgtggaagccgcgctggcgatggtgttcgacggcttcggagcggcgaaccaccgccagcccagatgcctgccgcaacgtatcgcggtgccggtcaccaagcttaagacttgccggctcgggatcaccgtggcatcggatgcgatcgagatccacggcggcaatggctacatcgagacctggccggtggcccggttgctgcgtgacgcgcaagtcaacacgatctgggagggccccgacaacatcctgtgtctggatgtgcggcgcgggatcgagcagacgcgcgctcacgagacactgttggcgcggctgcgcgatgcggtgtcggtgtccgacgatgacgacaccacgcggctggtctcgcgccgcattgaggacctcgacgcggcgatcaccgcttggaccaaactcgacaggcagctggccgaggcgcggctgttcccgctggcccaattcatgggcgacgtctacgccggcgcgttgctcaccgagcaggccgcctgggaacgggcaacccgcggcaccgaccgcaaggcactcgtcgcccgcctgtacgcgcgccggtatctcgccgaccaaggcccgctgcgcggtatcgacgcagattgcgatgaggcgctgcagcgtttcgacgaactcgtggcgggcgcgttcactgccgagcagacgtaa

SEQ ID NO: 532 - DNA, 5202 bp, Mycobacterium Tuberculosis
atggctgacgtagcggaatcccaggagaacgcccccgccgaaagggccgagctaacggtccccgagatgcgccagtggctgcgcaactgggtgggtaaggccgtcggaaaggcaccggactcgatcgacgaatcggtgcccatggtggagctgggtctgtcgtcgcgcgatgccgtcgcgatggccgccgacatagaagacctgaccggggtcacgctgtcggtcgcggtggcgttcgcgcatccgaccatcgaatcgctggccacccggatcatcgagggcgagccggagaccgacctagcgggcgatgacgccgaagactggtcgcgcaccggcccggccgagcgcgtcgacatcgcgatcgtgggcttgtccacccgcttcccgggcgagatgaacacccccgagcagacctggcaggcgctgctggaaggccgcgacgggatcaccgacctgcccgacgggcgctggtcggaattcctcgaagagccgcggctggccgcgcgggtcgccggggcccgcacccggggcggctacctgaaggacatcaagggcttcgattcggagttcttcgcggtggccaagaccgaagccgacaacatcgacccgcagcagcggatggcgctggagctgacctgggaggcgctcgagcacgcccgcatcccggcgtcgagcctgcgcggccaggccgtcggtgtgtacatcggcagctccaccaacgactacagcttcctggcggtgtcggacccgacggtcgcgcacccgtatgcgatcaccggcaccagcagctcgatcatcgccaaccgggtgtcctacttctacgacttccacggaccgtcggtcaccattgacaccgcgtgctcgagttcgctggtggccatccaccagggggtgcaggcgctgcgcaacggcgaggccgacgtagtggtcgccggcggggtgaacgcgttgatcacaccgatggtcaccctgggtttcgacgagatcggtgcggtgctggcgcccgacggccggatcaagtcgttctcagccgacgccgacggctacacccgctccgaaggcggcggcatgctggtgctcaagcgggtcgacgacgcccgccgcgacggcgacgcgatcctggccgtgatcgccggcagcgcggtcaaccacgacggccggtccaacggcctgatcgcacccaaccaggacgcgcaggccgacgtgctgcgccgggcctacaaggacgccggcatcgatccgcgcaccgtcgactacatcgaggcgcacggcaccggcaccatcctcggcgacccaatcgaggccgaggcgctgggccgggtggtcggtaggggccgtccggccgatcggccggcgctgctgggtgcggtgaaaaccaacgtcgggcacctggaatcggcggccggcgcggccagcatggccaaggtggtgctggcgctgcagcacgacaaactgccgccgtcgatcaacttcgccggccccagcccctacatcgacttcgacgcgatgcggttgaagatgatcaccacgcccaccgactggccgcgatacggcggctacgcgctggccggggtgtccagcttcggcttcggcggcgccaacgcgcacgtggtggtgcgcgaggtcctgccgcgtgacgtggtggaaaaggaaccggaacccgagccggaacccaaggcggccgccgaacccgccgaggcgcccacgttggcaggccacgcgctgcggttcgacgagttcggcaacatcatcaccgactcggcggtcgccgaagagccggagcccgaactgcccggagtcaccgaggaggcgctgcggctcaaggaagccgcgttggaagagcttgcggcccaagaggttacggcaccattggtcccgttggcggtgtcggcgtttctgacgtcccgcaagaaggcggcggccgccgagttggcggactggatgcaaagcccggaaggccaggcctcctcgctggaatcgatcggcaggtcgttgtcgcggcgcaaccacggccgttcccgcgcggtggtgttggcccacgaccacgacgaggccatcaagggcctgcgcgcggtcgccgcgggcaagcaggcgccgaacgtgttcagcgtcgacgggccggtgaccaccggcccggtctgggtgctcgccggattcggcgcccagcatcgcaagatgggcaagagcctgtacctgcgcaacgaggtgttcgcggcgtggatcgagaaggtcgacgccctggtccaagacgagctgggctactcggtgctggagctgatcctggacgacgcgcaggactacggcatcgagaccacccaggtcaccatcttcgcgatccagatcgcgctgggtgagctgctgcgccatcacggcgccaaaccggccgcggtcatcggccagtcgctgggtgaggccgcgtcggcctacttcgccggcgggctgtcgctgcgggatgccacccgggcgatctgctcgcgctcgcacctgatgggcgagggtgaggcgatgctgttcggcgagtacatccggttgatggcgctggtggaatactccgccgacgaaatcagagaagtgttctccgacttccccgatctggaggtgtgtgtctacgccgcgcccacccagacggtcatcggcggcccccccgagcaggtggacgcgatccttgcccgcgccgaggccgagggcaagttcgcccgcaaattcgcgaccaagggcgccagccacacctcgcagatggacccgctgctgggcgagctcaccgcggagctgcaaggcatcaagccgacgagcccgacgtgtgggatcttctcgacggtgcacgagggccgctacatcaaacccggcggcgaacccatccacgacgtcgaatactggaagaaggggctgcggcattccgtctacttcacccacggcatccgcaacgccgtcgacagcgggcacaccaccttcctggagctggcacccaatccggtggcgctgatgcaggtcgccctgaccaccgccgatgccgggctgcatgacgcccagttgatcccgacgctggcccgcaagcaagacgaggtctcctcgatggtctcgaccatggcgcagctgtatgtgtacggccacgacctggacatacgcacgctgtttagccgcgccagtgggccgcaggattacgcgaacattccgccgacccggttcaagcgcaaggagcactggctgcccgcgcacttctccggcgacggctcgacgtacatgccgggcacccatgtcgccctgccggatgggcggcacgtctgggagtacgcgccgcgggacggcaatgtggacttggccgcgttggtcagggccgccgccgcccacgtgcttccggacgcgcaactgaccgccgccgagcagcgcgcggtgcccggcgacggcgcccggctggtgacgacgatgacccgtcaccccggcggcgcctcggtgcaggtgcacgcccgcatcgacgagtccttcacgctggtctacgacgccctggtgtcccgagcggggtccgaatcggtgttgcccaccgcggtgggtgcggcgacggcgatcgcggttgcggacggggcgcctgtcgcgccggaaacgcccgccgaagacgcggacgccgagacgctttcggacagcctgaccacccgttacatgccgtccggcatgacccgatggtcgcctgattccggtgagaccatcgccgagcggctgggcctgattgtcgggtctgcgatgggctatgagcccgaggacctgccgtgggaggtgccgctgatcgagcttggcctggactcgctgatggcggtgcgcatcaaaaaccgcgtcgagtacgacttcgacctgccaccgatccagctgaccgcggtgcgcgacgccaacctctacaacgtggagaagctgatcgaatacgcggtcgagcaccgtgacgaggtgcagcagctgcacgagcaccagaaaacccagaccgctgaggagatcgcgcgggcccaggccgaattgctgcatggcaaggtgggcaagaccgagccggtcgactcggaagccggggttgcgctcccgtcgccgcaaaacggcgagcagccaaacccgacagggcccgcgctcaacgtcgacgtgccgccgcgggacgctgccgagcgggtcaccttcgccacctgggcgatcgtcaccggcaagtccccgggcggcatcttcaacgagctgcccaggctggacgacgaggccgcggccaagattgcgcagcggctttccgagcgcgccgaaggcccgatcaccgccgaggacgtgctgacgtcgtcgaacatcgaggcgctggccgacaaggtgcgcacgtatttggaggccgggcagatcgatgggttcgtccgcaccctgcgggcgcggcccgaagcaggcgggaaggtgccggtgttcgtgtttcatccggccggcggctcgacggtggtgtacgagccgctgctgggccggctgccggcggacaccccaatgtatggcttcgaacgggtcgaggggtcgatcgaagagcgtgcacagcagtacgtgccgaagctgatcgagatgcagggcgacgggccctatgtcctggtgggttggtcgctgggcggtgtgctggcctacgcgtgcgcgatcggtttgcggcggctgggcaaggacgtgcggttcgtcgggctgatcgacgcggtgcgcgccggtgaggagatcccgcagaccaaggaggagatccgcaagcgctgggaccgctacgccgccttcgccgagaagacgttcaacgtgaccatcccggcgatcccgtacgagcagctcgaggagctcgacgacgagggccaggtccggttcgtgctggacgccgtcagccagtccggtgtgcagatcccggccgggatcatcgaacaccaacgcacgtcgtatctggacaaccgggcgatcgacaccgcccagatccagccgtacgacgggcatgtcaccctctacatggccgatcgctaccatgacgacgcgatcatgttcgagccccgctacgccgtgcgccagccggacggcgggtggggcgagtacgtttccgacctcgaggtggtgccgatcggtggcgagcacattcaggccatcgacgagccgatcatcgccaaggtgggcgaacacatgagccgcgcgttggggcagatcgaggccgatcgaacaagtgaggtaggcaagcagtga

SEQ ID NO: 533 - DNA, 900 bp, Mycobacterium Tuberculosis
atgaagggtcggtcggcgctgctgcgggcgctctggattgccgcactgtcattcgggttgggcggtgtcgcggtagccgcggaacccaccgccaaggccgccccatacgagaacctgatggtgccgtcgccctcgatgggccgggacatcccggtggccttcctagccggtgggccgcacgcggtgtatctgctggacgccttcaacgccggcccggatgtcagtaactgggtcaccgcgggtaacgcgatgaacacgttggcgggcaaggggatttcggtggtggcaccggccggtggtgcgtacagcatgtacaccaactgggagcaggatggcagcaagcagtgggacaccttcttgtccgctgagctgcccgactggctggccgctaaccggggcttggcccccggtggccatgcggccgttggcgccgctcagggcggttacggggcgatggcgctggcggccttccaccccgaccgcttcggcttcgctggctcgatgtcgggctttttgtacccgtcgaacaccaccaccaacggtgcgatcgcggcgggcatgcagcaattcggcggtgtggacaccaacggaatgtggggagcaccacagctgggtcggtggaagtggcacgacccgtgggtgcatgccagcctgctggcgcaaaacaacacccgggtgtgggtgtggagcccgaccaacccgggagccagcgatcccgccgccatgatcggccaagccgccgaggcgatgggtaacagccgcatgttctacaaccagtatcgcagcgtcggcgggcacaacggacacttcgacttcccagccagcggtgacaacggctggggctcgtgggcgccccagctgggcgctatgtcgggcgatatcgtcggtgcgatccgctaa

SEQ ID NO: 534 - DNA, 1017 bp, Mycobacterium Tuberculosis
atgcagcttgttgacagggttcgtggcgccgtcacgggtatgtcgcgtcgactcgtggtcggggccgtcggcgcggccctagtgtcgggtctggtcggcgccgtcggtggcacggcgaccgcgggggcattttcccggccgggcttgccggtggagtacctgcaggtgccgtcgccgtcgatgggccgtgacatcaaggtccaattccaaagtggtggtgccaactcgcccgccctgtacctgctcgacggcctgcgcgcgcaggacgacttcagcggctgggacatcaacaccccggcgttcgagtggtacgaccagtcgggcctgtcggtggtcatgccggtgggtggccagtcaagcttctactccgactggtaccagcccgcctgcggcaaggccggttgccagacttacaagtgggagaccttcctgaccagcgagctgccggggtggctgcaggccaacaggcacgtcaagcccaccggaagcgccgtcgtcggtctttcgatggctgcttcttcggcgctgacgctggcgatctatcacccccagcagttcgtctacgcgggagcgatgtcgggcctgttggacccctcccaggcgatgggtcccaccctgatcggcctggcgatgggtgacgctggcggctacaaggcctccgacatgtggggcccgaaggaggacccggcgtggcagcgcaacgacccgctgttgaacgtcgggaagctgatcgccaacaacacccgcgtctgggtgtactgcggcaacggcaagccgtcggatctgggtggcaacaacctgccggccaagttcctcgagggcttcgtgcggaccagcaacatcaagttccaagacgcctacaacgccggtggcggccacaacggcgtgttcgacttcccggacagcggtacgcacagctgggagtactggggcgcgcagctcaacgctatgaagcccgacctgcaacgggcactgggtgccacgcccaacaccgggcccgcgccccagggcgcctag

SEQ ID NO: 535 - DNA, 1884 bp, Mycobacterium Tuberculosis
atggtccgggtcagcttgtggctgtcggtgacggcggtcgccgtgctgttcggctgggggagctggcaacgtcgctggatcgctgacgacggactgatcgtcctgcggacggtacgcaacctattggccggcaacggaccggtcttcaaccagggcgagcgagtcgaagcgaacacctcgacagcgtggacgtatctgctgtatgtgggcggctgggtgggcgggccgatgcgcctggagtacgtggcgttggccctggccatggtgctttcgctgctgggaatggtgctgctcatgctggggaccggccggttgtacgcacccagcctgcggggccgtcgggcgatcatgcttccggccggggcgctggtatatatcgcggtgccaccggcccgcgacttcgccacctccggcctggagagcgggctggtgttggcctatctggggctgttgtggtggatgatggtctgctggtcacagccgctgcgggcccgcccggacagccagatgttcctcggcgcgttggccttcgtcgccggatgcagcgtgctagtgcggccggaattcgcgctgatcggcgggctggcgctgatcatgatgttgatcgccgcgcggacctggcgtcgccgcgtgctgatcgtgctggccggcggattcttgccggtggcctaccagatcttccggatgggctattacggactgctggttccgagtaccgcgctggccaaggatgccgcgggcgacaagtggtcgcaaggcatgatctacgtgtcgaacttcaaccggccgtacgcactgtgggtgccgttggtgctgtcggtgccgctgggattgctgttgatgacggcgcgccgccggccgtcgttcctgcgtcccgtgctggcacccgactacggtcgggtggcccgggcggtgcaaagtccgccggccgtggtggctttcatcgtcggcagcggcgtgctgcaggcgctgtactggattcggcaaggcggcgactttatgcacggccgggtgttgctggcgccgctgttttgtttgctggccccggtgggggtcattcctattttgctgcccgacggtaaggacttttcgcgggagaccggtcgctggctagtcggcgcgctcagcgggctctggctggggatcgcgggttggtcgctgtgggcggcaaactcgccgggcatgggtgacgacgccacccgggtcacctattcgggcatcgtcgacgagcgccgcttctacgcccaggccaccgggcacgcgcatccgctgaccgccgcggactacctcgattacccgcgaatggctgccgtgcttacagcgctcaacaacaccccggaaggggcgttgctattgccgtcgggcaactacaaccagtgggacctggtgccgatgatccggccctcgtcggggaccgcgccgggtggcaagccggcgccgaaaccgcagcacgcagtgtttttcaccaacatgggcatgctaggcatgaacgtcgggctcgatgtccgggtgatcgaccaaatcgggctggtaaacccattggccgcgcacaccgagcggctgaagcatgcccgtatcggccatgacaagaatctgttcccggactgggtgatcgccgacggaccctgggtgaagtggtacccgggtattcccggctacatcgaccagcagtgggtcacgcaagccgaagcggccctgcaatgccccgcgactcgggcggtgcttaattctgtgcgcgccccgatcaccctgcaccgattcctctccaacgtgttgcattcctacgagttcacccgttaccgcatcgaccgcgttccgcgctatgaattggtccggtgtgggctcgatgttcccgacgggcccggcccgccaccgcgggagtga

SEQ ID NO: 536 - DNA, 855 bp, Mycobacterium Tuberculosis
gtgccgaaccgacgccgacgcaagctctcgacagccatgagcgcggtcgccgccctggcagttgcaagtccttgtgcatattttcttgtctacgaatcaaccgaaacgaccgagcggcccgagcaccatgaattcaagcaggcggcggtgttgaccgacctgcccggcgagctgatgtccgcgctatcgcaggggttgtcccagttcgggatcaacataccgccggtgcccagcctgaccgggagcggcgatgccagcacgggtctaaccggtcctggcctgactagtccgggattgaccagcccgggattgaccagcccgggcctcaccgaccctgcccttaccagtccgggcctgacgccaaccctgcccggatcactcgccgcgcccggcaccaccctggcgccaacgcccggcgtgggggccaatccggcgctcaccaaccccgcgctgaccagcccgaccggggcgacgccgggattgaccagcccgacgggtttggatcccgcgctgggcggcgccaacgaaatcccgattacgacgccggtcggattggatcccggggctgacggcacctatccgatcctcggtgatccaacactggggaccataccgagcagccccgccaccacctccaccggcggcggcggtctcgtcaacgacgtgatgcaggtggccaacgagttgggcgccagtcaggctatcgacctgctaaaaggtgtgctaatgccgtcgatcatgcaggccgtccagaatggcggcgcggccgcgccggcagccagcccgccggtcccgcccatccccgcggccgcggcggtgccaccgacggacccaatcaccgtgccggtcgcctaa

SEQ ID NO: 537 - DNA, 1620 bp, Mycobacterium Tuberculosis
atggcagcgaccgtcgtcatcgtcgcgtggatagcgaatcgtccacccgccagctcccatgaaccatcgccgacgcccaacacccagctcgccgagcagccactgatcgggctcggcggcggcgtcacggtacgcgaactcacccaggacacaccgttttcattggtggcgttgactggcgacctggccggtacctccgctcgtgtgcgcgccaagcgcccggacggtgactgggggccgtggtatcagaccgagtatgaaaccgaaccacgcgatccggcgggcaccgacgggtccgtggaacttggaggactcaatccgggtccccgtagcaccgatccggtgttcgtgggcaccaccaccaccgtgcaggtcgcggtgactcgcccgatcgacgcaccgataactcaaccgccggcggggcggccgcccaacgacttgctcgacagcggtttgggataccgtccagccaccaaggaacagccattcgggcagaacatctccgcgatcctgatctcgccgccgcaagcgccgcccggaacgcagtggacgccaccaaccgcagtcaccatggcaggccagccgccggccatcatcagccgggcggaatggggcgcagacgagtcactgcgatgcgaaacaccggagtacgacaggggggttcgtgccgcggtggtccaccacaccgcggggagcaacgactactctccgctggagtccgccggcatagtcaaagccatctacacttaccacagcaagaccctgggctggtgtgacatcgcgtacaacgccctcgtcgacaagtacggccaggtgttcgagggtagcgccggcggcctcaccaagccggtcgaagggttccacaccggcggattcaaccgcaacacctggggggttgccatgatcggcaacttcgacgatgtggcccccacgccgatccagatccgaaccgtcggccggctgctcggctggcggctgggcatggacgacgtcgatcccaggagcatggtggatctgcagtcagcgggtagctcgtacaccacgtttccgggtggcgccatagcgcgattgcccgccatcttcacccatcgcgacgtcggcaacaccgactgtccgggcaacgccgcctacgctgtgatggacgagatccgggacatcgcagcacatttcaacgacccgccggaggagctgatcaaggcgctggaaggcggcgcgatctatcagcgctggcaggcgttgggcggcatgaacagcgcgctgggtgcaccgacctcgccggaggccgacgccgcggatggggcgcggtatgcaaccttcgctaagggcgccatgtattggtcgccggtgaccgacgctcagccgatcacgggggcaatctatgaggcctgggcttcgcagagctacgaacgcggcccgctgggactgccgaccagcgcggagatccaggagccgctgcagatcacgcagaactttcaacacggaaccttgaacttcgagcgcctcaccggcaatgtcaccgaagtcgtcgacgggatcacgacgccactggcgacgcggcccccgagcggcccgacggtgccgcccgaacacttcacgctgccaacgcatccgatcacctga

SEQ ID NO: 538 - DNA, 822 bp, Mycobacterium Tuberculosis
ttgaaaccgactgtgccggcgctcgtcgcgtgtgacgtcgacggaaccctgctcgatgacggagaaaccgtcaccaaacgcactcgcgacgcggtgcatgccgcggtagacgccggcacgcacttcatcctggccaccggccggccgccgcgctgggtgcgacccatcgtcgatgccctcggcttcgcgccgatggcggtgtgcgccaacggcgccgtcatctacgaccccgggaccgatcgggtgatgtcggtgcgcaccctgcccgtcgacgccctggcaacgttggccgaagttgcgacccgcgtcataccgggtgcgggactggcggtcgagcggatcggcgagcgcgcacacgacacggcgaccccccagttcgtcagctcgccgggctacgagcatgcgtggctgaatccggacaacaccgaagtgtcgatcgaccacctgctcagcgcgccggcgatcaaactgctgatccgtaaagccggtgctgccagtgccgacatggccgccgaactggctaagcatgtcggtttcgagggcgatatcacctactcgaccaataacgggctggtggagatcgtgccgctcggtatcagcaaggccaccggtgtcgacgagattgcccggccgcttggaatttccgacgcggaggtggtggcgttcggcgacatgcccaacgacgtgccgatgctgctgcgggccggtttgggtgtggcgatgggtaacgcgcatcccgacgcgctggccgtcgccgacgaggtcactgcacccaatagcgaggacggcgtcgcgcgggtgctggagcgctggtggtcctag

SEQ ID NO: 539 - DNA, 1551 bp, Mycobacterium Tuberculosis
gtgcaggtcacaagcgttggtcacgccggctttctgatccagacccaggccggcagcatcctgtgcgacccttgggtcaatccggcctactttgcgtcttggtttccgttccccgacaacagcgggctggactggggcgctttgggtgagtgcgattatctgtatgtctcgcacctacataaggaccacttcgacgcggaaaatctacgagcgcacgtcaacaaggacgccgtcgtgctgctgcccgactttccggtacccgacctgcgaaatgagttgcagaagttaggatttcatcggttcttcgaaaccaccgactcggtcaaacaccgcctgaggggacccaacggcgatctcgacgtgatgatcatcgcactgcgggcccccgccgacggtccgatcggcgactcggcgctagtcgttgccgacggcgaaacaacggctttcaacatgaacgacgcccgcccggtcgatttggacgtgctggcatcggagttcggtcacatcgacgtgcatatgctgcagtactcgggcgcgatctggtacccgatggtctacgacatgccggcgcgcgcgaaggatgcgttcggcgcccaaaagcggcaacggcagatggaccgtgctcgccagtacatcgcgcaggtgggagcgacgtgggtggtgccgtcggcggggccgccatgctttttagcccccgagctgcgccacctcaacgacgacggtagcgatccggccaatatcttccccgaccagatggtgttcctggatcagatgcgggcgcacggccaggacggcgggctgctgatgatccccggctcgactgcggatttcactggtacaaccctgaattcattgcgccatccactgcccgccgaacaggtcgaggccatctttaccaccgacaaagccgcatacatcgctgactatgccgaccggatggcgccggtgctcgccgcgcaaaaggctggctgggccgccgccgccggcgagccactgctgcagccgctgcgcaccctgttcgagccgatcatgctgcaaagcaacgagatctgcgacggcatcggatacccggtcgagctcgccatcggtcccgaaaccattgttttggactttccgaaaagagctgtacgagaaccgattcccgacgagaggttccgctacgggttcgcgatcgcgccggagctggtgcgcacggtgctgcgcgacaacgaacccgactgggtcaacaccatcttcttatccacccgatttcgggcatggcgggttggtggctacaacgaatacctttacacgttcttcaagtgtctgaccgacgaacgcatcgcctacgccgacggctggttcgccgaggcccacgatgactcctcatcgatcaccctgaacggttgggagatccagcgccgctgcccccatctcaaagccgacctatcgaaattcggtgtggtggaaggcaacacgctcacttgtaacctgcacggctggcagtggcgtctggacgacggtcgctgcctcaccgcccggggccatcaactacgcagttcacggccatga

SEQ ID NO: 540 - DNA, 612 bp, Mycobacterium Tuberculosis
ttgtcggtggtgtgctgtaggaacagatggatgaatttggcggtgtgggcggagcgcaacggtgttgcgtgggtgatcgcgtatcgctggtttcgagccgggctgttgccggttccggcgcagcgagtgggtcggctcattctggtgaacgatccggcagtcgaggagtctgggcgcgggcggacgttggtgtacgcgcgggtatcgtcagcggatcagaggtccgatctggatcggcgggtcgcgcgggtgaccgcgtgggccacatcgcaacatctctctgtcgacaaggtggtggccgagggtggttgggcgttgaatggacatcgccgtaagttttttgcgctgctgggtgatccggtggtgacgcggatcgtggtggagcaccgggatcggttctgctggtttggctctgagtacgtcgaggccgctcttgtcgcccagggccgggaattggtggtggtcgacttggctgaggttgatgacgacctggtgggcgatatgaccgagatcctgacctcgatgtgtgctcggctctatggtgaacgcgctgcacagaacggggccaagcgtgcccttgctgctgcggtcggggacgcggaggcagcttga

SEQ ID NO: 541 - DNA, 1008 bp, Mycobacterium Tuberculosis
atggacccggtaacagcgctgcggcagatcgcctattacaaggaccggaaccgccacgacccgaggcgggtgatggcctatcgcaatgccgccgacattatcgagggccttgacgacgcggcgcggcagcggcacggccaggccaacagctggcagtcgctggcgggtatcggtcccaaaaccgcgaaagtcatcgcccaggcctggtctggccgcgagccggacctgctggctgaattacgcgctgacgctgaggatctcggtggaggggcgatccgtgccgcattgcgcggggatctgcatctgcattcgaactggtcggacgggtccgcgccgatcgaggagatgatggccaccgcggcggcgctaggtcaccagtactgcgcattgaccgatcactcaccgcggttgacgatcgccaacggcctgtctccggaccggttgcgcaagcagctggacgtgatcgacgagctgcgcgagaagttcgcgccgctgcgcatcctgaccgggatcgaggtcgacatcctcgaagacgggagcttggaccaggaacccgagatgctggaccgcctcgacatcgtggtggccagcgtgcactccaagctgtcgatggattcggcagcgatgacgcgacggatggtgcgcgccgtggccaacggtcacaccgacgtgctgggccactgcaccggccggctgatcgccggcaatcgtggcatccggccagaatcgaagttcgatgcagaggcggtgttcaccgcctgccgtgagcacggcaccgccgtggagatcaactcccgtccggaacgccgagacccaccgacgcgcctgttgcacctagcgcgcgacatcggctgcgtgttcagcatcgacaccgacgcgcacgcacccggccagctggacttcctcggctacggcgcccagcgcgccttggacgcggaggtgcccgccgaccggatcgtcaacacctggccggccgacacgctcctggcgtggaccgggtcgcattag

SEQ ID NO: 542 - DNA, 1173 bp, Mycobacterium Tuberculosis
atgtacgagcgtgacgaattcctgcgcgatcggatccgaccacaccagcccggcaccccgcggggatactcgccccgtccgccgtccggagatcgctgccccgcgccaccgcctggccggcacgctgctgccgctacgccaccagggccgccgcgcctgccttcagctccactgcgtccattgccggacccggcttggccacgccagccggaggccccgccaccgagcacctgggccgaccccgccctggcgccgatacgcagtcggacgcgacccggcgagcgtggttggcgacgcatggtgcggctggtcacctttggccttgtcggcctgggccggtcgggcatgcagcgccaggaggcccaattcgaagcaacgatacgaaccgtcctgcatggcaaccacaaggtcgccgtgctgggcaaaggaggtgtgggaaagacgtcggttgcggcgtgcgtcggatcgatccttgccgaactgcgccagcaggaccgtatcgtcgggatcgacgccgacaccgccttcggcaggctgagcagccgaatcgatcctcgagcagctggttcgttctgggagctgaccaccgacacgaatctgcggtccttcaccgatatcaccgcgcgcctgggccgaaattccgcgggactgtacgtcctggcaggccagccggcatccggtccgcgccgggtgctcgatccggccatctaccgcgaagccgccctaaggttggatcaccatttcgcaatctcggtgatcgactgcggttcctccatggaggcggcggtcacccaggaagtattgcgcgatgtggatgctctgatcgtggtgtcctcgccctgggcggatggtgcctccgctgccgccaacaccatcgaatggctgtcggattatggcctgacaggtttgttgcgacgcagcatcgtggtgctcaacgattcggacggacacgccgacaagcgcaccaagtcattgctggcccaggaattcatcgaccacgggcagcctgtggtcgaggtgcccttcgatccccatttgcggcccgggggggtcatcgatatgagccacgaaatggccccgacgacgcggctgaaaatcctgcaggtcgccgcgacggtgacggcgtacttcgcgtcgcgacccgccgacgcacacggcagcccgccccggtga

SEQ ID NO: 543 - DNA, 327 bp, Mycobacterium Tuberculosis
gtgacctggctggctgacccggtcggcaacagcaggatcgcccgagcgcaggcctgcaaaacgtcaatctcggcgcccatcgtcgaatcctggcgggcgcaacgcggcgcgcaatgtggacagcgcgagaaatcttgtcgatgttctcgcgctgtccacatccagggcatctcaccgccactgttccgcagacccctcgaaccagcggtccaggcggcggttgcgtcatgccgattgggcagacacccggtggtcgcgcaccgggtaaccgttgcgctcggccagggatcgcagctggcccaacgcgaatgcccgcgcccggcctga

SEQ ID NO: 544 - DNA, 351 bp, Mycobacterium Tuberculosis
atgcgatacgctttcgcggcagaggctacaacctgcaacgctttctggaggaacgtagacatgacagtaaccgccctgtatgaggtcccgctcggcgtttgcacgcaagatcccgatcgttggacgacgactcccgacgacgaggccaagaccctgtgccgggcttgcccgcgccggtggctgtgtgcacgcgacgccgtcgagtccgcgggtgcggaagggctgtgggcaggggtcgtaattcccgaatcaggccgggcgcgggcattcgcgttgggccagctgcgatccctggccgagcgcaacggttacccggtgcgcgaccaccgggtgtctgcccaatcggcatga

SEQ ID NO: 545 - DNA, 1209 bp, Mycobacterium Tuberculosis
atggcatcgggtagcggtctttgcaagacgacgagtaactttatttggggccagttactcttgcttggagagggaatccccgacccaggcgacattttcaacaccggttcgtcgctgttcaaacaaatcagcgacaaaatgggactcgccattccgggcaccaactggatcggccaagcggcggaagcttacctaaaccagaacatcgcgcaacaacttcgcgcacaggtgatgggcgatctcgacaaattaaccggcaacatgatctcgaatcaggccaaatacgtctccgatacgcgcgacgtcctgcgggccatgaagaagatgattgacggtgtctacaaggtttgtaagggcctcgaaaagattccgctgctcggccacttgtggtcgtgggagctcgcaatccctatgtccggcatcgcgatggccgttgtcggcggcgcattgctctatctaacgattatgacgctgatgaatgcgaccaacctgaggggaattctcggcaggctgatcgagatgttgacgaccttgccaaagttccccggcctgcccgggttgcccagcctgcccgacatcatcgacggcctctggccgccgaagttgcccgacattccgatccccggcctgcccgacatcccgggcctacccgacttcaaatggccgcccacccccggcagcccgttgttccccgacctcccgtcgttcccagggttccccgggttcccggagttccccgccatccccgggttccccgcactgcccgggttgcccagcattcccaacttgttccccggcttgccgggtctgggcgacctgctgcccggcgtaggcgatttgggcaagttacccacctggactgagctggccgctttgcctgacttcttgggcggcttcgccggcctgcccagcttgggttttggcaatctgctcagctttgccagtttgcccaccgtgggtcaggtgaccgccaccatgggtcagctgcaacagctcgtggcggccggcggtggccccagccaactggccagcatgggcagccaacaagcgcaactgatctcgtcgcaggcccagcaaggaggccagcagcacgccaccctcgtgagcgacaagaaggaagacgaggaaggcgtggccgaggcggagcgtgcacccatcgacgctggcaccgcggccagccaacgggggcaggaggggaccgtcctttga

SEQ ID NO: 546 - DNA, 2244 bp, Mycobacterium Tuberculosis
atgacgaccaagaagttcactcccaccattacccgtggcccccggttgaccccgggcgagatcagcctcacgccgcccgatgacctgggcatcgacatcccaccgtcgggcgtccaaaagatccttccctacgtgatgggtggcgccatgctcggcatgatcgccatcatggtggccggcggcaccaggcagctgtcgccgtacatgttgatgatgccgctgatgatgatcgtgatgatggtcggcggtctggccggtagcaccggtggtggcggcaagaaggtgcccgaaatcaacgccgaccgcaaggagtacctgcggtatttggcaggactacgcacccgagtgacgtcctcggccacctctcaggtggcgttcttctcctaccacgcaccgcatcccgaggatctgttgtcgatcgtcggcacccaacggcagtggtcccggccggccaacgccgacttctatgcggccacccgaatcggtatcggtgaccagccggcggtggatcgattattgaagccggccgtcggcggggagttggccgccgccagcgcagcacctcagccgttcctggagccggtcagtcatatgtgggtggtcaagtttctacgaacccatggattgatccatgactgcccgaaactgctgcaactccgtacctttccgactatcgcgatcggcggggacttggcgggggcagccggcctgatgacggcgatgatctgtcacctagccgtgttccacccaccggacctgctgcagatccgggtgctcaccgaggaacccgacgaccccgactggtcctggctcaaatggcttccgcacgtacagcaccagaccgaaaccgatgcggccgggtccacccggctgatcttcacgcgccaggaaggtctgtcggacctggccgcgcgcgggccacacgcacccgattcgcttcccggcggcccctacgtagtcgtcgtcgacctgaccggcggcaaggctggattcccgcccgacggtagggccggtgtcacggtgatcacgttgggcaaccatcgcggctcggcctaccgcatcagggtgcacgaggatgggacggctgatgaccggctccctaaccaatcgtttcgccaggtgacatcggtcaccgatcggatgtcgccgcagcaagccagccgtatcgcgcgaaagttggccggatggtccatcacgggcaccatcctcgacaagacgtcgcgggtccagaagaaggtggccaccgactggcaccagctggtcggtgcgcaaagtgtcgaggagataacaccttcccgctggaggatgtacaccgacaccgaccgtgaccggctaaagatcccgtttggtcatgaactaaagaccggcaacgtcatgtacctggacatcaaagagggcgcggaattcggcgccggaccgcacggcatgctcatcgggaccacggggtctgggaagtccgaattcctgcgcaccctgatcctgtcgctggtggcaatgactcatccagatcaggtgaatctcctgctcaccgacttcaaaggtggttcaaccttcctgggaatggaaaagcttccgcacactgccgctgtcgtcaccaacatggccgaggaagccgagctcgtcagccggatgggcgaggtgttgaccggagaactcgatcggcgccagtcgatcctccgacaggccgggatgaaagtcggcgcggccggagccctgtccggcgtggccgaatacgagaagtaccgcgaacgcggtgccgacctacccccgctgccaacgcttttcgtcgtcgtcgacgagttcgccgagctgttgcagagtcacccggacttcatcgggctgttcgaccggatctgccgcgtcgggcggtcgctgagggtccatctgctgctggctacccagtcgctgcagaccggcggtgttcgcatcgacaaactggagccaaacctgacatatcgaatcgcattgcgcaccaccagctctcatgaatccaaggcggtaatcggcacaccggaggcgcagtacatcaccaacaaggagagcggtgtcgggtttctccgggtcggcatggaagacccggtcaagttcagcaccttctacatcagtgggccatacatgccgccggcggcaggcgtcgaaaccaatggtgaagccggagggcccggtcaacagaccactagacaagccgcgcgcattcacaggttcaccgcggcaccggttctcgaggaggcgccgacaccgtga

SEQ ID NO: 547 - DNA, 303 bp, Mycobacterium Tuberculosis
atggcagagatgaagaccgatgccgctaccctcgcgcaggaggcaggtaatttcgagcggatctccggcgacctgaaaacccagatcgaccaggtggagtcgacggcaggttcgttgcagggccagtggcgcggcgcggcggggacggccgcccaggccgcggtggtgcgcttccaagaagcagccaataagcagaagcaggaactcgacgagatctcgacgaatattcgtcaggccggcgtccaatactcgagggccgacgaggagcagcagcaggcgctgtcctcgcaaatgggcttctga

SEQ ID NO: 548 - DNA, 288 bp, Mycobacterium Tuberculosis
atgacagagcagcagtggaatttcgcgggtatcgaggccgcggcaagcgcaatccagggaaatgtcacgtccattcattccctccttgacgaggggaagcagtccctgaccaagctcgcagcggcctggggcggtagcggttcggaggcgtaccagggtgtccagcaaaaatgggacgccacggctaccgagctgaacaacgcgctgcagaacctggcgcggacgatcagcgaagccggtcaggcaatggcttcgaccgaaggcaacgtcactgggatgttcgcatag

SEQ ID NO: 549 - DNA, 843 bp, Mycobacterium Tuberculosis
atggctgaaccgttggccgtcgatcccaccggcttgagcgcagcggccgcgaaattggccggcctcgtttttccgcagcctccggcgccgatcgcggtcagcggaacggattcggtggtagcagcaatcaacgagaccatgccaagcatcgaatcgctggtcagtgacgggctgcccggcgtgaaagccgccctgactcgaacagcatccaacatgaacgcggcggcggacgtctatgcgaagaccgatcagtcactgggaaccagtttgagccagtatgcattcggctcgtcgggcgaaggcctggctggcgtcgcctcggtcggtggtcagccaagtcaggctacccagctgctgagcacacccgtgtcacaggtcacgacccagctcggcgagacggccgctgagctggcaccccgtgttgttgcgacggtgccgcaactcgttcagctggctccgcacgccgttcagatgtcgcaaaacgcatcccccatcgctcagacgatcagtcaaaccgcccaacaggccgcccagagcgcgcagggcggcagcggcccaatgcccgcacagcttgccagcgctgaaaaaccggccaccgagcaagcggagccggtccacgaagtgacaaacgacgatcagggcgaccagggcgacgtgcagccggccgaggtcgttgccgcggcacgtgacgaaggcgccggcgcatcaccgggccagcagcccggcgggggcgttcccgcgcaagccatggataccggagccggtgcccgcccagcggcgagtccgctggcggcccccgtcgatccgtcgactccggcaccctcaacaaccacaacgttgtag

SEQ ID NO: 550 - DNA, 348 bp, Mycobacterium Tuberculosis
gtgagcatggacgaattggacccgcatgtcgcccgggcgttgacgctggcggcgcggtttcagtcggccctagacgggacgctcaatcagatgaacaacggatccttccgcgccaccgacgaagccgagaccgtcgaagtgacgatcaatgggcaccagtggctcaccggcctgcgcatcgaagatggtttgctgaagaagctgggtgccgaggcggtggctcagcgggtcaacgaggcgctgcacaatgcgcaggccgcggcgtccgcgtataacgacgcggcgggcgagcagctgaccgctgcgttatcggccatgtcccgcgcgatgaacgaaggaatggcctaa

SEQ ID NO: 551 - DNA, 1860 bp, Mycobacterium Tuberculosis
atgtcgagaatggtggacacgatgggtgatttactcactgcgcgccggcatttcgatcgggcgatgacgatcaagaatggccagggatgcgtggcggcgttgcctgagtttgtggctgccaccgaggccgatccgtcgatggccgacgcgtggctgggtcgtatcgcctgcggtgaccgcgatctggcctcgcttaagcagctcaacgcccatagcgagtggctgcaccgcgagaccacgcggatcggccggacgttggccgctgaggtccagctgggaccatccatcgggatcacggtgaccgacgcatctcaggtggggctggcgctgtcgtcggcgttgacgatcgcgggggagtatgcgaaggccgatgccctgttagcaaaccgcgagctattggattcgtggcgcaactaccagtggcatcagctggctcgggcgttcctgatgtacgtcacgcagcgatggcccgacgtgttgtcgacggccgccgaggatctgccgccacaggcgatcgtcatgccggcggtgaccgcgtcgatttgtgcgctggcagcccacgccgccgcccatctcgggcaggggcgagtggccctggactggctggaccgggtggacgtgatcggacacagcaggtcatcggagcggttcggcgccgacgtgctcaccgcggcgatcggaccggccgatattccgctgctggtcgccgacttggcgtatgtgcgggggatggtgtaccggcaactgcatgaggaggacaaggcccagatctggctgtcgaaggccaccatcaacggggtgctcaccgacgccgccaaagaagccctggcggacccgaacctgcgcttgattgttaccgatgaacgaaccatcgccagccgctccgaccgttgggatgcttcgacggcgaaaagccgcgaccagctcgatgacgacaatgcagcgcagcggcgcggcgagctgctagccgagggccgggaactgctggccaaacaggtgggcctggcggcggtcaagcaagcggtatcggcgctggaagaccaactcgaggtgcgcatgatgcgcctagagcacggcctaccggtggaggggcagaccaaccacatgttgctggtggggccaccaggcacaggtaagacaaccaccgctgaagcgctcggcaagatctacgccggcatggggatcgtgcgtcaccccgaaattcgagaagttcgccgatcggacttctgtgggcactacatcggggagtcaggacccaagacgaacgagctgatcgaaaagtcactcgggcgaatcattttcatggacgagttctactcgctgatcgaacgtcatcaagacggaacaccggacatgatcggcatggaggcggtcaatcaactcctggttcaattggaaacacaccgattcgacttctgtttcatcggggccggctatgaggatcaggtggatgaattcctcaccgtgaacccgggtttggctggccggttcaaccgaaagctgcggttcgagtcttattcgccggtggagatcgtcgagattggacaccgctacgctacaccgcgcgccagccagctcgatgacgccgcacgggaggtattcctcgacgcggtcaccaccatccgtaactacaccacccctagtgggcagcacggtatcgacgctatgcaaaacggtcggttcgcccgcaacgtgatcgaacgcgccgaagggttccgggacacccgggtggttgcgcaaaaacgtgcgggccaaccggtatcggttcaggatctgcagatcatcaccgccaccgacatcgatgccgcgatacgcagcgtgtgctcagacaaccgagacatggccgcgatcgtttggtag

SEQ ID NO: 552 - DNA, 324 bp, Mycobacterium Tuberculosis
gtggcagacacaattcaggtaacaccgcagatgctgcgcagcaccgccaacgatatccaggcgaatatggagcaagccatgggaatcgccaagggctacctagccaaccaggaaaacgtcatgaaccccgccacctggtctggtaccggcgtcgttgcttcgcatatgacagccaccgagatcaccaatgaattgaacaaggtccttaccgggggcacgcgcctggccgagggcctcgtgcaggccgcagccctgatggagggacacgaggcggactcgcagacagcgtttcaggcgctgttcggcgctagccacggatcctga

SEQ ID NO: 553 - DNA, 633 bp, Mycobacterium Tuberculosis
atgatgcaacaagcggtgtcgggcattaccggcgcgctcggcggcgcggtcggcggcgtcatgggcccactcacgcagcttccccagcaggccatgcaagcggggcagggagcaatgcagccgctgatgagtgcgcttcaacagacctatggcgcggagggactggacgtcgcggacggggcgcggctggtggacagcatcgaaggtgagcccggcctcggcggcgagccgggcgctggtgacgtcggcgccggcggcgggggtggtggcaccaccccgacgggctatctgggtcccccacccgtgccgacgtcgtcgccaccgacgactccagccggggcgccggccaagtcggtgacgccggacccggttagtggcaccccgcgggcgtcggggccggccggcatgaccggcatgccgatggtgccgccgggcgcgttgggtgcgggcgcggaaggagccaataaggacaagccggtcgagaagcgggtgacgggctgtgccgaatggtcaaccggtcaagggccgcttaacagtaccgccgagtgttccggtgaaatctgccgacgacaagccggtggtcaccaagtcgacgcgacggatccttgttgtgccgaacgacgacaaggttaa

SEQ ID NO: 554 - DNA, 1443 bp, Mycobacterium Tuberculosis
gtgccggaagccgtccaggaagccgatctgctaaccgccgctgcggttgccttgaacaggcatgctgccttattgcgggaactcgggtcggtgttcgccgccgcgggacacgagttgtatctggtcggcggttcggtgcgagatgcactgttgggccggttgagccccgacctggacttcaccaccgacgcccgtcccgagcgggtgcaggagatcgtgcggccgtgggccgatgcggtgtgggataccggaatcgaattcggcaccgtcggcgtgggtaagagcgaccaccgcatggagatcaccacattccgtgccgacagctacgaccgggtttcgcgtcatccagaggtacgtttcggcgattgcctcgagggcgatctggtccgccgcgacttcaccacgaacgcaatggctgtgcgcgtcaccgccactgggccgggcgaattcctggatccgcttggtggcttggcggcgctgcgggccaaggtgttagacaccccggcggcgccgtcggggtcctttggcgacgatccgttgcggatgctgcgcgccgcgcggttcgtctcgcaacttggattcgcggtggcgccgcgggtgcgcgcggcgatcgaagagatggcgccgcagttggcccgaatcagcgccgaacgggtggccgccgagctggacaagctgctggtcggtgaggatccggccgcgggtatcgacctgatggtgcagagcggtatgggtgctgtggtcttgcctgaaatcggtgggatgcggatggcgatcgacgaacatcaccagcacaaggacgtctatcagcattccttgaccgtgctgcggcaggcgatcgcgctggaggacgacggcccggatctggtgttgcgctgggcggcgctgctgcacgacatcggcaagcccgccacccgccgtcacgaacccgacggtggggtgagcttccatcaccacgaagtggtcggcgccaagatggtgcgcaagcggatgcgggcgctgaagtattccaagcagatgatcgacgacatctcgcagctggtctacctgcatctgcggtttcacggctacggcgatgggaaatggaccgactctgcggtgcgccgctatgtcaccgacgccggggccctactgccacggctgcacaagctggtgcgcgccgactgcacgacccgcaacaagcgccgggccgcgcggttgcaggccagttacgaccggctggaagagcggatcgcggagctggccgcccaggaggatctggatcgggtgcgccccgacctggacggcaaccagatcatggcggtgctcgacattccggcgggcccgcaagtcggcgaggcgtggcgctacttgaaggagctgcggctagagcgcggcccgttgtccaccgaggaggcgacaaccgagctgctgtcctggtggaaatcacgggggaaccgctag

SEQ ID NO: 555 - DNA, 381 bp, Mycobacterium Tuberculosis
atgagcaaccggattgtgttagaacccagcgccgatcacccgatcaccatcgagccgaccaaccgacgggtgcaggtacgcgtcaatggcgaggtggtcgcggacacggccgcggcgctgtgcttgcaggaagccagttaccctgcagtgcaatatattccgttggccgacgtggtacaggataggctgatccgcaccgagaccagcacctattgcccgttcaagggtgaagccagctattacagcgtgactaccgacgccggcgacatcgtcgacgacgtgatgtggacgtacgaaaacccttatccggcggtagcggcgatcgcggggcatgtcgcgtgctatccggacaaagccgaaatcagcatcttcccggggtag

SEQ ID NO: 556 - DNA, 1101 bp, Mycobacterium Tuberculosis
atgacagatccgcagacgcagagcaccagggtcggggtggttgccgagtcggggcccgacgaacgacgggtcgcgctggttcccaaggcggtcgcgtcgctggtgaaccgtggtgtggcggtcgtggtcgaggccggtgcgggcgagcgcgcgctgcttcccgatgagctctacaccgctgtcggtgccagcatcggggatgcttgggccgccgacgtcgttgtcaaggtcgcgccgccgacggcggcggaggtcggccggttgcgcggtgggcagacactgatcggctttctagcgccccgtaatgctgacaactcgatcggcgcgctgacccaggccggggtgcaggcgttcgcgctcgaggccatcccgcgcatctcgcgggcgcaggtgatggacgcgctgtcgtcgcaagccaacgtgtctgggtataaggctgtgctgctcgcggcctcggaatcgacccggttctttccgatgctgacgacggcggccggaacggtgaagccggccacggtgctggtgctcggcgtcggcgtggccggcctgcaggcgctggcgacggccaaacggctaggcgcgcgcaccacgggctacgatgtgcgtcccgaggtggccgaccaggtccgatcggtgggcgctcaatggcttgatttgggcatctcagcgtccggtgagggcggttacgcccgcgaactgaccgacgacgagcgcgcccagcagcaaaaggcattggaagaagcgatcagtggcttcgacgtggtgatcaccaccgcgctggtgccgggccgcccggcgccaacgttggtgaccgccgctgcagtggaagcgatgaagcctggcagcgtggtggtggatctcgccggcgagacgggcggcaactgcgaattgaccgagcccggccggacagtcgtcaagcacgacgtcaccattgccgcaccgctgaacctgccggccacgatgcccgagcacgccagcgagctctacagcaagaacatcaccgcgctactcgacttgttgatcaaagacggcaggctggccccggacttcgacgacgaggtgattgcccagtcgtgtgtcacccgcgggaaggactcctag

SEQ ID NO: 557 - DNA, 972 bp, Mycobacterium Tuberculosis
gtgacacacggaatggtgctcggcaagttcatgccgccccatgcgggacacgtctacctttgcgagttcgcgcggcgatgggtggatgagctgaccatcgtcgtcggatcaacggcagcagagccgattccgggcgcccagcgcgttgcatggatgcgggagctgttccccttcgatcgcgtggtccatctggccaacgagaacccgcagcgcccgtgggagcacccggacttctgggacatctggaaggcgagcctgcagggcgtgctggcaacccgccccgacttcgtcttcggtgccgagccctacaacgcggactttgcccaggtcctcggagcgcgtttcgtggcggtcgatcacggtcgcaccgtcgttcccgtgactgcaaccgacatccgcgcggacccgcttggccactggcaacacatcccacggtgcgtgcggccggccttcgtcaaacgcgtgagcatcatcggacccgaatccaccgggaagaccacgctggcacaggcggttgcggaaaagctccgaacgaagtgggtcccggagcgggcgaaaatgttgcgggagctcaatggcggctcactgataggactggagtgggccgaaatcgttcgcggacagatcgcgtcggaggaagccttggctcgtgacgccgatcgcgtcctgatctgcgacacggatccgctcgcgacgaccgtgtgggccgagttcctggcgggcggctgcccgcaagagctccgtgatctagctcggcgtccctacgatctcacactgctcaccacgcccgatgtgccctgggacgccgacgacggacgctgtgtccccggcgcacgcggtacctttttcgcccgctgcgagcaggctctccgcgccgcgggacgatcattcgtggtgatcacgggcggttgggaagagaggctttcggtgtctttgcgcgctgtcgaagaacttgtgcgtgcccgccgctaa

SEQ ID NO: 558 - DNA, 1134 bp, Mycobacterium Tuberculosis
ttgactggtcgtgctgccacgcccggggtcatccgagagttcgtcgggctgccgtcgcgaaccgcggggcgtgcggctgccggtgggcacccatgccaggggctgtaccaccacagcgtgggacgcaaaccgaaggtggcgctcatcgccgcgcactaccagatcgatttctccgagcactatctcgccgagtacatggcgatccgcggcatcgggtttctgggctggaacacccgattccgtggtttcgaaagcagctttctgctcgatcacgcactggtcgacatcggcgtcggggtgcgctggctccgcgaagttcagggcgtggaaacagtggtgttgcttggcaattcaggtggtggctcattgatggccgcctaccaatcacaagcggtcgatccgaacgtgactcccctggacggtatgcgacccgcagccggggtaaccgaattgccggccgccgacgcatacgttgccgccgcagctcatcccggccgtccggatgtgctcaccgcttggatggacgccgccgtcattgacgaaaatgatccggttgcaaccgatcccgaacttgacctgttcgacgaacgcaacgggccgccgtactcaccggagtttatcagccggtatcgctccgcgcaggtcaaacgcaaccacaccatcaccgactgggccgaatccgaactcaaacgtgttcgcgcagctggcttttctgatcggccgttcagcgtgatgcgtacctgggccgacccgcgcatggtcgatcccagcatcgaaccgaccaagcgtcggcccaaccagtgctacgcgggcacgccggtgaaggcgaaccgctccgcacacggcatcgccgcggcctgcacgctgcgcggctggctgggcatgtggagcctgcgggtggcccaaacccgtgccgcaccccacctggcccggatcacctgcccggccctggtgctcaacgccgaggccgacaccggaatcttcccgtcggatgcccagcagatctacgacgggctcgccagcagcgacaagactcaggtctcgatcgacaccgaccattacttcaccaccccgggcgcccgcagcgagcaggccgacaccatcgccaagtggatagccaagcggtggcgctga

SEQ ID NO: 559 - DNA, 216 bp, Mycobacterium Tuberculosis
gtggacaagacgacggtctacctgccggatgaactcaaggcggccgtgaagcgcgccgctcggcagcgcggagtctccgaagcgcaggtaatccgggagtccatccgggcggcggtcggcggcgccaagccgccgccgcgcgggggtctatatgcgggttcggagcccatcgcgcggcgagtcgacgagctgctggctggcttcggtgagcggtga

SEQ ID NO: 560 - DNA, 303 bp, Mycobacterium Tuberculosis; identical to SEQ ID NO: 444

SEQ ID NO: 561 - DNA, 405 bp, Mycobacterium Tuberculosis
atggaggcgctggcagatgtcggcgtcctggcttcgtggtcaccgctgcacaaacaggtggaagtgatcgactactacccggatggccggccgcaccatgtgagggcaaccgtcaagattctggggctcgtcgacaaagaggtcctcgaatatcactggggcccggactgggtgtgctgggatgccgatcagaccttccagcaacatggacagcacatcgagtacaccgtgaaacctgagggtgtcgatagggcccgggtgcgcttcgacatcaccgtcgagccggcgggaccgatccccggcttcatcgtcaagcgggcaagtgagcatgtgttggatgccgcggcgaaagggctgcagaagttgatcgcgggtgccggcgatcaaggaaacgcgaaatcgtga

SEQ ID NO: 562 - DNA, 1296 bp, Mycobacterium Tuberculosis
gtggccgacaccgacgacaccgcaaccctccgttacccgggaggcgagatcgacctgcagatcgtgcacgccaccgaaggcgccgacggcattgcgctcgggccgctgctggcaaaaaccgggcacaccacgttcgacgtcggcttcgccaacacggccgccgctaaaagctccatcacctacatcgacggagatgccggcattctgcgttatcgcggctacccgatcgaccaactggcggagaagtcaaccttcatcgaggtctgctacctgttgatttacggcgagctgcccgataccgaccagcttgcccagttcaccggccggatccagcgccacaccatgctgcacgaggatctcaagcggttcttcgacggctttccgcgcaatgcccacccgatgccggtgttgtccagcgtggtcaatgcgctgtcggcgtactaccaggatgctctggaccccatggacaacggtcaagtcgagctgtcgaccattcggctgctggccaagctgcccaccatcgccgcgtacgcctacaagaaatcggtcggccagcccttcctctacccagataactcactgacgctggtggagaacttcctacggttgacgttcggatttcccgccgagccctaccaggccgaccccgaggtggtgcgggcgctggacatgttgttcatcttgcacgccgaccacgagcagaactgctcgacgtcgacggttcggctggttggctcgtcgcgagccaacctgttcacctcgatctcgggtggcatcaacgcactatggggtccgcttcatggcggcgccaatcaggctgtcctggagatgctcgagggcattcgcgacagcggcgacgacgtcagcgagtttgtacgcaaggtcaagaaccgcgaggccggggtcaaattgatgggtttcggtcatcgtgtctacaagaactacgatccgcgggcccgcatcgtcaaggaacaggccgacaagatcctggccaagctcggcggcgatgactccttgctgggcatcgccaaggagctcgaagaggcggcgctgaccgacgactacttcatcgaacgcaagctttaccccaacgtcgacttctacaccggcctgatctaccgggccctcggcttcccgaccaggatgttcaccgtgttgtttgccctgggcaggcttcccggctggatcgcgcactggcgtgagatgcacgacgagggcgacagcaagatcggccggccccgccagatctacaccggctacacggagcgcgactacgtcaccatagacgcgcggtag

SEQ ID NO: 563 - DNA, 315 bp, Mycobacterium Tuberculosis
gtgaccggcaagggcatcgttgagtcgacgaccaagacgaagcgggatcgtcacgtaccagtgcctgagcctgtttggcgcaggctccatgccgagttgcccaccgacccgaacgccttggtgttccccggccgtaagggcggattcctgcctctcggtgaataccgctgggcattcgacaacgccggcgaccaggtcgggatcgaaggctggtaccgcacggtctggggcacaccacggcctcgctggcgatcagcgcaggcgctaacgtcaaggtcgtgcaacggctccttggacacgcagcagcggcgatga

SEQ ID NO: 564 - DNA, 915 bp, Mycobacterium Tuberculosis
atggccgtcgctattgcccgtccgaaattggaaggaaacatcgccgtcggcgaggaccgccggatcggcttcgccgagttcggcgccccgcagggtcgtgcggtcttctggctgcatggcaccccaggggcccggcggcagatcccgaccgaagcccgggtctacgccgagcaccacaatattcgtctgattggcgtcgatcggcccggcatcggcgcctcgacgccgcatcagtacgaaaccatcttggcgttcgccgacgatctgcggaccatcgccgacacgctcggcatcgacaagatggccgtggtgggcctgtcgggcgggggcccatacaccctggcgtgcgccgccgggctgcccgaccgggtggtcgccgccggtgtcctcggcggcgtcgcgccgacgcgcggcccggacgcgattagcggcggtttgatgcgccttggttcggcggtggcgccgctgctgcaggtgggcggcaccccgctgcggctgggtgcgagcttgctgatccgggcggcccggcccgtcgcgtcccctgccctcgacctgtatggcctgctctcaccgcgggccgaccggcatttgctggctcggcccgagttcaaggcgatgttcctcgacgatctgctcaacggtagtcgcaagcagctcgctgcgccgttcgccgatgtcatcgcctttgcccgcgactggggattccggctggacgaggtgaaagtccccgtccgctggtggcacggagaccacgaccacatcgtcccgttctcccacggggaacacgtcgtatcccggcttcccgacgcgaagttgttgcacttgcccggcgaaagtcatctcgctgggcttggccgtggtgaagagattttgagcaccctgatgcagatttgggaccgcgacctgcggaaatga

SEQ ID NO: 565 - DNA, 567 bp, Mycobacterium Tuberculosis
atgacaacatcccgcgtgcccctgttgccggtcgacgaggccaaagctgctgccgacgaagcgggcgtgcccgactacatggctgagctcagcatcttccaagtgttgctgaatcatccgcgactagcgcggaccttcaacgacctgctcgccaccatgctgtggcacgggaccctggactcacggttgcgtgagttggtgatcatgcggattggttggctcaccgactgtgactacgaatggacccaacactggcgggttgcttcagggcttggcgtgtcggccgacgatctgctcggtgtacgggattggcaagggtacaacgggttcgggcccgctgagcaggccgtcctggcggccaccgatgacgtggtgcgcgagggcgcggtgagtgcgcagagctggtcggcttgcgagcgggaattacattgcgacaaagtggttctcatcgaactcgttacggtgataagcgcatggcgaatggtcgcttcgatcctgcacagcctcgaggtcccactggaagacggcgtttccagctggccgcccgacggcctttcgccaaggtga

SEQ ID NO: 566 - DNA, 2715 bp, Mycobacterium Tuberculosis
gtggtgactactgccagtgcccccagcgaggatcgagccaagccgacgctgatgttgctggatggcaattcgctggcgtttcgggcgttctacgcactgcccgcggagaacttcaagacccgcggcgggctgaccaccaacgccgtctacggcttcaccgccatgctgatcaacctgctgcgcgatgaagccccgacgcacatcgcggcggctttcgacgtgtcccggcagaccttccgcttgcaacgctacccggagtacaaggccaaccgatcgtcgacccccgacgagttcgctggccagatcgacatcaccaaagaagtgctgggcgcactcggcatcaccgtgctctccgagccggggttcgaggccgacgacctcatcgccacgctggccacccaggccgagaacgagggctaccgggtgctggtggtcaccggggatcgtgacgcactgcaactggtcagtgacgatgtgacggtgctctacccccgcaagggcgtcagcgaacttacgcgcttcacaccggaggccgtcgtcgaaaagtacgggctcacccctaggcagtacccggacttcgccgcgctgcgcggcgaccccagcgataacctgcccggcatacccggggtgggggagaagaccgccgccaaatggatcgccgagtacggctcgctgcggtcactggtggacaacgttgacgccgtgcgcggcaaggtgggcgatgcgctgcgggcgaacctggccagcgtggtgcgcaaccgtgagctcaccgacctggttcgcgacgtgccgctggcccagaccccggacacgctgcggctgcagccctgggatcgcgaccacattcaccggctcttcgacgacctggagtttcgggtgttgcgcgaccggttgttcgacacgttggccgcggccgggggacccgaggtcgacgaggggttcgacgtgcgcggcggcgcgttggcgcccggcacggttaggcaatggttggccgagcacgccggcgacgggcgccgagcgggcctgacggtggtgggtacccatctgccgcacggtggggacgctaccgctatggccgtcgccgccgccgacggcgaaggcgcttacctcgataccgcgacgctgacgcccgacgacgacgccgcgttggcggcctggctagcggatccagctaaacccaaagccttgcatgaggcaaaggcggccgttcatgacctggcgggtcgtggttggaccttggagggcgtcacctccgacaccgcactggcggcctacctggtgcggccggggcagcgcagcttcaccctcgacgacctctcgctgcgctatctgcgtcgcgagctgcgtgcggaaacaccgcagcagcaacaactttcactgctcgatgacgacgatacggacgccgagaccattcaaacgacgatcctgcgggcgcgggcagtcatcgacctggccgacgcgctggacgccgagttagcgcgtatcgactccaccgcgctgctgggggagatggagctgccggtccagcgggtgctggcgaagatggaaagtgccggtatcgccgtcgacctgcccatgttgaccgagctgcaaagccagtttggcgaccagatccgcgacgccgccgaggccgcctacggcgtgatcggcaagcaaatcaacctgggctcacccaagcagctgcaggtcgtgctgttcgacgaactgggcatgccgaagaccaaacgcaccaagaccggctacaccacggatgccgacgcgctgcagtcgttgttcgacaagaccgggcatccgtttctgcaacatctgctcgcccaccgcgacgtcacccggctcaaggtcaccgtcgacgggttgctccaagcggtggccgccgacggccgcatccacaccacgttcaaccagacgatcgccgcgaccggccggctctcctcgaccgaacccaacctgcagaacatcccgatccgcaccgacgcgggccggcggatccgggacgcgttcgtggtcggggacggctacgccgagttgatgacggccgactacagccagatcgagatgcggatcatggcgcacctgtccggggacgagggcctcatcgaggcgttcaacaccggggaggacctgcattcgttcgtcgcgtcccgggcgttcggcgtgcccatcgacgaggtcaccggcgagctgcggcgccgggtcaaggcgatgtcctacgggctggcttacgggttgagcgcctacggcctgtcgcagcagttgaaaatctccaccgaggaagccaacgagcagatggacgcgtatttcgcccgattcggcggggtgcgcgactacctgcgcgccgtagtcgagcgggcccgcaaggacggctacacctcgacggtgctgggccgtcgccgctacctgcccgagctggacagcagcaaccgtcaagtgcgggaggccgccgagcgggcggcgctgaacgcgccgatccagggcagcgcggccgacatcatcaaggtggccatgatccaggtcgacaaggcgctcaacgaggcacagctggcgtcgcgcatgctgctgcaggtccacgacgagctgctgttcgaaatcgcccccggtgaacgcgagcgggtcgaggccctggtgcgcgacaagatgggcggcgcttacccgctcgacgtcccgctggaggtgtcggtgggctacggccgcagctgggacgcggcggcgcactga

SEQ ID NO: 567 - DNA, 3036 bp, Mycobacterium Tuberculosis
atgtcgttcttactcgtggagccggacttggtcacagcagcggccgccaatttagctggtattcgctcggcactgagcgaagccgctgccgccgcatcgacccccacgaccgcgctggcatcggccggcgccgatgaggtgtcggcggctgtctcgcgactattcggcgcctacggtcagcaatttcaagcgctcaacgcccgggcggcgacgtttcacgccgagttcgtgagcttgttgaacggcggcgcggcggcctataccggcgccgaggccgccagcgtgtcgtcgatgcaggccctgctcgacgcggtgaatgcgcccacgcagacgctgctggggcgcccactgatcggcaacggcgccgatggagtggcggggaccgggtcaaatgccggcggcaacggcgggcccggtggaattttgtacggcaacggcggcaacggcggggccggcggtaacggcggggccgccggattgatcggcaacggcggcgccggcggcgccggcggtgctggaggtgcaggcggcgctggcggggccggcggcaccggcggactgttgtatggcaacggcggtgccggcggcaacgggggcagtgccgctgcggccggtggggccggcggcaacgccctgctgttcggcaacggcgggaacggcggaagtggggcttccggcggagccgccggccacgccgggacgatatttggtaacggcggcaatgctggggccggatcggggctagccggcgcggacggcgggttgttcggcaatggcggggacggtggttccagcacctcgaaggctggcggtgcaggtggaaatgcactgttcggcaacggcggggacggcggatcgagcaccgtcgccgccgggggtgcgggcgggaataccctggtcggcaatggcggtgccggcggcgctggcggcaccagcggtctcaccggtagcggcgtggccggcggggccggcggcagcgtcggcctgtggggctccggcggtgccggcggcgacggcggcgccgccacgtcattgttgggcgtcggcatgaacgccggcgctggcggggccggcggcaacgccggcctgctgtacggcaacggcggtgccggtggggccggcggcaatggtggggatacgacggtgccattgttcgactccggcgtcggcggtgccgggggtgctggcggcaacgccagcttgttcggtaacggtgggaccggtggcgtcggcggcaagggggggacgagcagcgatctggccagcgctaccagcggagccggcggggccggcggggccggcggcgtcggcgggctgctctacggcaacggcgggaacgggggggccggtggcatcggcggggctgctatcaacatactcgccaacgccggtgccggcggcgccggtggtgccgcgggcagtagcttcatcggcaatggcggcaacggtggggccggtggcgccggtggggctgcagcgctatttagctccggtgtcggcggtgccggcggcagcggcggcaccgcgttgcttctcggcagcggtggggccggtgggaacggcggcactggtggggctaactctggctccctcttcgcaagtcccggcggtaccggcggtgccggcggtcacggcggtgccggcgggctgatatggggcaacggtggggccggtgggaacggcggcaacggtggcaccaccgccgatggcgcccttgagggtggcaccggcggtatcggcggcaccggaggcagcgccatcgcgttcggtaatggcgggcagggcggcgccggtggtaccggtggggatcacagtggcggcaacggtatcggcggtaagggcggtgccagcggaaacggcggcaacgccggccaagtgttcggcgacggcgggaccggcggaaccggcggcgcgggcggcgccggttccggtaccaaggccggcggcaccggtagcgacggcggtcacggcggcaacgccaccttgatcggcaacggtggtgacggtggcgccggtggcgccggcggcgccggcagcccggccggtgccccgggtaatggcggcaccggtggcaccggcggggtgttgttcggccaaagtggcagctccggtccaccgggcgcggcagcgctggccttccctagcctgagcagcagtgttcccatcctcgggccatacgaagacctcatcgccaacacggtcgccaacctggcgagcatcggcaatacctggcttgccgacccggcgccgttcctgcagcagtacctcgccaaccagttcggctacggccagctgaccctaaccgcgctgacagatgccaccagggacttcgctattgggctggctggcataccgccgagcctgcaatcggccttgcaagccctcgcggcaggcgacgtcagcggcgcggtgaccgacgtgttaggggcggtggtgaaggtcttcgtcagcggtgttgacgcgagtgacttgtcgaacatcctgctgctcgggccggtgggagacctgttccccatcctgagcatccccggcgccatgtcacaaaacttcaccaatgtggtgatgacggtcacggacacaaccatcgccttttcgatcgataccacgaacttgaccggggtgatgacgtttggattgccgctggcgatgacccttaatgcggtgggttcgccgatcacgacggcaatcgcattcgccgagagcacgacagcgttcgtcagcgccgtgcaggccggaaacctgcaggcggcagcggcggccctggtcggtgctcccgccaacgtcgccaacggcttcctcaatggcgaggccaggctgccgctggccctgccaacatcggcgacaggggggattccggtgacggtcgaggttcccgtcggcggcattcttgcgcctctgcagccgtttcaggccacggcggtaataccggtcatcgggccggttaccgttacgctcgaaggtacgcccgccggcggcatcgttcccgcgttggtgaactacgctcccacacagctagcgcaggcaattgccccttag

SEQ ID NO: 568 - DNA, 1059 bp, Mycobacterium Tuberculosis
atggaagcgccaccatatgccggcgatccgacgttcgagcgtttgcggcgctcgtttcagccagccgatctactgccggaactgcaagcggcaggagtgcattacacaatcgctgtcgaggcggcggacgatccggccgagaatgagtctctgttggccactgcgcgccaccatgattggatagcgcgcgtgatcggttgggtcccactcgccgatccggatgaggttaccgagagctcgacgcacgggcggcaccgcccggacgcctcctggcgacgagatctgcggtgccccggcctgctgccgcccgggtgccaccagccagtcttggtcgtaggcttggtaggtcagcagccggaaatgcgaccgatgaatccaccaagtggttttctccggcggacgccgacccgcaggtttcgcgaccgccgcgatgctggtcgcgtattggccgacgaacttgcgtcctatcgcggcagggaccggttgctcgtcctcggccttgcccgcggtggcgtccccgtcggctgggaagtcgcgtcggcgctaggcgccgaattggatgtatttctggttcgcaagctcggcgtgccgcagtggcgcgagctggcgatgggcgcgttggccagtgggggcggggtcgtgatgaacgacgacgtggtttccagcttgcgcatcaccgaccagcaggtgcgtgcggcgatcgacagcgagacggcagagctgcagcggcgcgagctggcgtatcgcggcggacgccctgtcgtcgatccgcgcgccaggatcgtgatcctggttgacgacggcatcgccaccggcgcgagcatgctggcggcggtgcgcaccatccgtgccaccggaccggagtcgatcgtcgtcgcggtcccggtcggtccggccacagcctgccgcgagctcgcggcggaagccgacgacgtggtgtgcgcaaccatgccggcagcgtttgaggccgtcggccaggtctataacgactttcatcaggtcaccgacgacgaggtccgcgagctgctcgcgacgccaaccacaggcgcagcgacctaa

SEQ ID NO: 569 - DNA, 939 bp, Mycobacterium Tuberculosis
atgccgctcagctctcgtatgcccggactcacctgcttcgaaatctttctggccatcgctgaggccggcagtcttggcggcgccgcacgcgaactcgggttgactcaacaagctgtgtcaaggcggctcgcatcgatggaggcccagatcggggtgcgattggccatccggacgacacgtggctcccaactcacgcctgccggcatcgtcgtcgccgaatgggcggcccgcttgctcgaagtcgccgacgagatcgatgccggcctcggctcgctgcgcaccgaaggccgccagcgcatcagagtggtggccagccagacgatagccgaacagctgatgccgcattggatgctgtccttgcgggccgccgacatgcgccgcggtggtactgtccctgaggtaatcctgaccgccaccaatagcgagcatgcgatcgcagccgttcgtgacggcatcgcagatcttggattcatcgaaaacccctgtcctcccacgggattaggcagcgttgtggttgcacgcgacgaactggtcgtcgtcgtgccgccgggtcacaagtgggcccgacggtcacgagtagtgagcgcccgggagctcgctcagacgcctttggtgactcgcgaaccgaactctggcatccgcgattcactcaccgcggcgttacgtgacacgctcggggaggacatgcagcaagcgccaccggtgctggaattatcatcggctgcggccgtgcgggccgcggtcttggccggcgctggaccggctgcgatgagccggctagcgatagccgatgacctggcgttcggtcgattactcgcggtcgacatccccgcgttgaacctgcggcgccagcttcgagccatctgggtcggtgggcgcaccccgccggcgggtgcgatacgagacctgctcagccacatcacttcccgcagcacgtag

SEQ ID NO: 570 - DNA, 549 bp, Mycobacterium Tuberculosis
gtgcgtgagcatcttatgagcatcgaggtagccaacgagtcaggcatcgacgtctcggaagcggaactagtcagtgtcgcacggtttgtcatcgccaagatggacgtcaatccgtgcgccgaattgtcgatgctgctgctggacaccgcggcgatggccgacctacacatgcgctggatggatcttcccgggccgaccgacgtgatgagcttcccgatggacgagctcgagccgggtggtcgccccgacgcccccgaaccgggaccgtccatgctgggcgatatcgtgctgtgcccggaattcgccgctgagcaggcggctgcggccggccacagcctgggccacgaattggccctgctgaccatccacggtgtgcttcacctgctcggctatgaccacgccgagccagacgaggaaaaagagatgttcgccctgcaggaccggttgcttgaagagtgggtagccgaccaggttgaggcctaccagcacgaccggcaggacgagaaggaccgccggttgctcgacaagtcaaggtattttgacctttga

SEQ ID NO: 571 - DNA, 1641 bp, Mycobacterium Tuberculosis
atggaccaacaccagcgaccggatccaatgggccccggctctcctcgcgccagcgctcgtcgaccggagccagatccgatgggcgagccgtggtggtcgcgagccgtgttctaccaggtctatccccgatcgttcgccgacagcaacggcgacggggtgggcgacctggacgggttggcgagccggcttgaccacctgcaacagctcggtgtcgacgcgatctggatcaacccggtcaccgtctcgccgatggcagaccacggatacgacgtcgccgatccccgcgacatcgacccactcttcggcgggatgccggcgttcgaacggttggtcgctgcggcacaccggcagggcatcaaagtcaccatggacgtggtgcccaaccacaccagttcggcgcacccatggtttcaggccgcgctggctgacctcccgggtagcccggcgcgggatcgctatttctttcgcgacgggcggggccccgacgggtcgctgccgccgaacaactgggagtcggtgttcggcgggccggcctggacccgagtgcgcgaaccggacggcaacccgggccagtggtacctgcaccttttcgacaccgaacagccggacctgaactgggacaacccggaaatccttgacgacttcgagaaaacactgcgcttctggctggaccgcggcgtggatggcttccgcatcgacgtggcgcacggcatggccaagcccccgggcctgccggactcaccggacctgggcatcgaggtgctgcaccaccgcgatgacgacccgcgcttcaaccacccgaatgtgcacgcgattcaccgcgacatccgcacggtgatcgacgagtaccccggagcggtaaccgtcggcgaggtgtgggtacacgacaacgcccgctgggcggagtatctgcggcccgacgaactgcatctcggcttcaatttccggctggcgcgaaccgagttcgacgccgccgagatccgcgacgcggtggcgaactccctggccgccgcggcgctgcagaacgcgaccccaacctggacgctggccaatcacgatgtgggacgggaggttagccgctacggcggcggcgagatcgggctgcgccgggccaaggcgatggcggtggtgatgctcgccctgccgggcgtggtcttcctctacaacggccaggaactgggtttgcccgacgtggacctgcccgacgaggtgctgcaggatccgacgtgggaacgctcgggacgcaccgaacgcggtcgcgatggctgccgggtgccgattccctggtcgggcaacattcccccgttcgggttctcgacgtgtccagacacctggttgccgatgccgccggaatgggcggcgctgaccgccgaaaaacaacgcgctgatgccggctcgaccttgtcgttttttcgacttgcactcagattacgtagggaacgaaatgaattcgacggcgacgtcgactggctggccgcgcccgacgatgcgctgatattccggcgtcacggcgggggtttggtgtgcgcgctcaacgccgctgagcgtccgctggcgctgccggcaggtgaacccatcctggccagcgcaccgttgaccgacgccacgttgccacccaatgccgcggcctggctggtgtag

SEQ ID NO: 572 - DNA, 531 bp, Mycobacterium Tuberculosis
atggcacccaaagcggttctcgtcggcctgccgggctccggcaagtccaccatcgggcgccggctggccaaggcgctcggggtcggcctgctcgacaccgacgtcgcgatcgagcagcggaccggacgcagcatcgccgacatcttcgccaccgacggggagcaggagttccgacgtatcgaggaggacgtggtgcgcgcggcactggccgaccacgacggtgtgctgtcgctcggcggcggcgcggtgaccagccccggtgtgcgcgcggcgctggccggccacaccgtcgtctacctggagatcagcgccgccgagggcgtgcgccgcaccggcggcaacaccgtgcgcccactgctggccggccccgaccgcgccgaaaaataccgcgcgctgatggccaagcgggcaccgctgtaccggcgcgtcgcgaccatgcgagtggacaccaatcgccgcaaccccggggcggtggtccgccatatcctgtcgcggctgcaggttcccagccccagcgaggcggccacatga

SEQ ID NO: 573 - DNA, 927 bp, Mycobacterium Tuberculosis
gtggatttgagcgcctctaggtccgatggtggcgacccgctgcgcccggcttcgccgcgcttgcgatcgcctgtgtccgatggtggcgacccgctgcgcccggcttcgccgcgcttgcgatcgcctgtgtccgatggtggcgacccgctgcgcccggcttcgccgcgcttgcgatcgccactgggcgcgagtcgcccggtggttggcctgacggcttatctggagcaggtgcgcaccggggtttgggatattcctgcgggttatctgcccgccgattacttcgaaggcatcaccatggccgggggtgttgcggtactgctgccgccgcagccggtcgaccccgagagcgtcggctgcgtgctggacagcctgcacgctctggtgatcaccgggggctacgacctggacccggcagcttatggccaggagccgcatccggccaccgatcaccctcgcccgggccgcgacgcttgggagttcgcgctattgcggggcgcgcttcagcgggggatgcccgtgttgggcatctgtcgcggcacccaggtgctcaacgtcgcgctcggcggcacgctgcaccagcacctgcccgacatccttggccatagcgggcatcgggcgggcaacggggtcttcaccaggttgccggtccacaccgcatcgggcacccggttggccgagctgatcggcgaatccgccgacgtgccgtgctaccaccaccaagccatcgaccaggtcggtgagggcctggtggtcagtgcggtggatgtcgacggggtaatcgaggcgctggagctacctggggacacgttcgtactagcggtgcagtggcatccggagaagtcgttggacgatctgcggctgtttaaggcgttggtggacgccgccagcggatacgcgggccggcagagccaagcggagccacgatga

SEQ ID NO: 574 - DNA, 6336 bp, Mycobacterium Tuberculosis
atggaatcacgtgtcactcccgttgcggtgatcgggatgggatgtcggcttcctggggggatcaactcgcccgacaaactgtgggagtcgttgctgcgcggtgatgacttggtcaccgagattccgcccgaccgctgggacgccgacgactattacgaccctgagccaggggttcccgggcggtcggtgtcccggtggggtgggttccttgacgacgtcgccggtttcgatgctgagttcttcgggattagcgagcgggaagcgacctcgatcgatccgcagcagcggctactgctggaaacgtcgtgggaggcgatcgagcatgctggtctggatccggcgtcgttggccgggtcctcgacggccgtttttactgggctgacccacgaggactacctggtactcaccacaacggcgggcggtttggccagtccatatgtggttaccggcctcaacaacagtgtggcgtcagggcggatcgcgcacacattgggtctacatggtccggcgatgacgtttgacaccgcgtgttcttcgggtctgatggcggtgcacctggcctgccgcagcctgcatgacggcgaagctgacctcgctttggcgggcggttgtgcggtgctgctggagccgcatgccagtgtggcggcgtctgcgcagggcatgctgtcgtcaaccggtcggtgccattcattcgatgctgacgcggatgggtttgtgcgttccgagggctgcgcgatggtgttgctgaagcgactgccggatgcgctgcgcgacggtaatcggatcttcgccgtggtgcgtggcacggccaccaatcaggacggccgcacggagacgctcaccatgccgtccgaggacgcccaggttgccgtgtaccgtgcggcgttggcggcggcgggcgtgcagcccgaaacggtcggtgtggtcgaggcgcacggcaccggtacgccaatcggcgacccgattgagtaccgcagcctggcgcgggtgtatggcgcgggcaccccctgcgcgcttggatcggccaagagcaacatggggcacagcacggcatcggcggggaccgtcgggctgatcaaggcaattctgtcactgcggcacggggtggtgccgccgctgctgcatttcaatcggctgcccgatgagctttccgacgtcgagaccgggctctttgtgccgcaagcggttacgccgtggcccaacggtaatgatcacacaccgaagcgggtcgcggtgtcctcgttcgggatgtccgggaccaacgtgcatgccatcgtggaagaggccccagcagaagcttccgcacccgagagttcaccgggcgacgctgaggtgggcccgcggctattcatgctgtcgtccacgtccagcgacgcactgcgccagacggcccgccaactagccacctgggtggaagaacaccaggactgcgtggcggcctcggatctggcctacacgctggcgcgtggccgcgcgcaccggccggtgcgcaccgcggtggttgccgccaacctgccggagctcgtcgagggtttgcgcgaggtggccgacggtgacgccctctatgacgcggcggtgggacacggtgatcgaggaccggtctgggtcttctccgggcaagggtcgcagtgggcggcgatgggcacgcaattgctcgccagcgaaccagtgttcgcggccaccatcgccaagctggagccggtgatcgccgcagaatcgggattctcggtgaccgaggcgataacggcgcagcagaccgtgaccggaatcgacaaagtgcagccggcagtgttcgccgttcaggtcgcgttggccgccaccatggagcaaacctacggagtgcggccgggcgcggtcgtcggacactcgatgggtgagtcggccgcggccgtcgtcgcgggggcactgtcgctcgaggacgcggcgcgcgtcatttgccgccgctcgaagctgatgacccgcatagccggtgctggtgccatgggctcggtggaattgcccgccaagcaagtgaattcggagctgatggcacgcggaatcgacgatgttgtggtctcggtggtggcgtccccgcaatccacggtgatcggcggtacgagcgacaccgttcgtgacctcatcgcccgttgggagcagcgggacgtgatggcgcgcgaggtggccgtcgacgtggcgtcgcactcgcctcaagtcgatccgatactcgacgatttggccgcggcgctggcggacattgctccgatgacgcccaaggtgccgtactactcggcgaccctgttcgacccgcgcgagcagccggtgtgcgatggcgcttactgggtggacaatctgcgcaacacggtgcagttcgccgcggcggtgcaggctgcgatggaggacggctaccgggtcttcgcggagctgtcgccccacccgctgcttacccacgccgtcgaacagacgggccgaagcctcgacatgtcggtcgccgccctggccggcatgcggcgagagcagcctctgccgcatggtctgcgcggcttgctgacggagctgcaccgcgcgggcgccgctttggactattcggcgctgtatcccgctgggcggctggtggatgcgccgctgccggcgtggacccacgcccgcctattcatcgacgatgatgggcaagaacagcgggcacaaggtgcctgcaccatcaccgtgcatccgttgcttggctcgcatgtgcggctgactgaggaacctgagcgccacgtctggcagggcgacgttggcacctcggtgctgtcctggctcagcgatcatcaggtgcataacgttgccgcccttcccggcgccgcctactgcgagatggctttggctgcggccgctgaggtcttcggcgaagcggctgaggttcgcgacatcacctttgagcagatgttgttgctcgacgagcagaccccgatcgacgccgtcgcatcgatcgacgcgcctggtgtcgtcaacttcaccgtggagaccaaccgggacggtgaaaccacccggcatgccaccgcggcgctgcgcgccgccgaagatgactgcccgccgccggggtacgacatcaccgctctgctgcaggcgcatccgcacgccgtgaacgggaccgccatgcgggaatcgttcgccgagcgtggtgttactttgggcgccgcgttcggtggtctgaccaccgcgcataccgccgaggcgggagccgcgacggtgctggccgaggtcgcgctgcccgcgtcgatccggttccagcagggcgcctaccgaatccacccggcgctgctggacgcttgtttccagtcggtcggcgcgggcgtccaggccggtacggccactggtggcctgctgttgccgttgggtgtgcgcagcctgcgtgcctacgggcctacccgcaatgcccgctactgctacacgcggttgaccaaggccttcaacgacgggacccgaggtggtgaggccgacctcgacgtgctggacgagcacgggaccgtcctgttggccgtgcgtgggctacgcatgggaaccgggacctccgaacgcgacgagcgtgaccgcctagtcagcgagcggctactgaccctcggatggcagcagcgagcgctgcccgaggttggcgacggcgaggctggatcgtggctattgatcgacacttccaacgccgtcgacacccccgacatgttggcttccacgttgacggacgcgctgaagtcccacggcccccaaggcaccgaatgcgccagcctgtcctggtcggtccaggacaccccgcccaacgatcaagctggcctcgaaaagctgggcagccagctgcgtggccgcgatggtgtggtgatcgtgtatgggcctcgcgtcggcgaccccgatgagcacagtctgctggccggtcgtgaacaggtccgtcacctggttcggatcacccgggaactggctgaattcgagggcgagctgccgcgcttgttcgtggtgaccagacaagcccagatagtgaagccgcacgactcgggagaaagagccaacctggagcaggccggcctgcgtggtctgctacgggtgatcagcagtgaacatccgatgctgcgcaccaccttgatcgatgtggacgaacacacggacgttgagcgggtggcccagcagctgctgagcggatcggaagaggacgagacggcctggcggaatggcgactggtatgtggcccgcttgacccccagtccgctgggccatgaagagcggcgcaccgcggtcttggatcccgaccacgacggtatgcgggtgcaggtccgcaggccgggagacttgcaaacgttggaattcgttgcgagtgaccgagttccgcccggccccgggcaaatcgaagtcgcggtcagcatgtccagcatcaacttcgccgacgttttgatcgcgtttggacgattccccattatcgatgaccgcgagccgcagttgggtatggatttcgtcggtgtggtgactgcggtcggggaaggtgtcaccggtcaccaggtcggtgatcgtgttggcggtttctccgaaggtggctgttggcggacgttcctcacctgtgacgccaacctcgcggtcacgctgccgcccggcttgaccgatgagcaggcgatcacggcggccaccgcgcatgccaccgcctggtatgggctcaacgacctggctcagatcaaggccggtgacaaagtgttgattcactccgccaccggcggtgtggggcaggcggccatatcgattgcccgcgccaagggagcggagattttcgcgaccgccggcaatcccgcgaagcgagccatgctgcgcgacatgggcgtcgagcatgtctacgattcgcgcagcgtcgagttcgccgagcagatccggcgcgacaccgacgggtacggcgtggatatcgtgctgaactcgctgaccggcgccgcccaacgtgcggggctggagttgttggccttcggcggacgcttcgtcgaaatcggcaaggccgacgtttacggcaacacccggctggggctgttcccgttccgtcgcggactgaccttctactacttggacctcgcgctgatgtcggtcacccagcccgaccgggtccgtgagttgctggccacggtgttcaagctcaccgcagacggggtgctgaccgcaccgcaatgcactcattacccgttggccgaggcggccgacgccatccgggcaatgagcaacgccgagcacaccggcaaactcgtgctcgacgtaccgcgtagcggccgtagaagcgtggcggtcaccccggagcaagctccgctgtaccgccgcgacggctcctacatcatcaccggcggcctgggtggcctcggcctgttcttcgcctcgaagctggccgcggcgggctgtggccggatcgtgctgaccgcacgttcccagcccaaccccaaagcgcggcagaccatcgaaggcctgcgcgcggctggggccgacatcgtggtggagtgtggcaacatcgccgaacccgacacggcggaccggctggtgagtgcggcgaccgctaccgggcttccgctgcgcggtgtgctgcactcggcggcggtggtcgaggatgccacgctgaccaacatcaccgatgagctcatcgatcgcgactggtcgcccaaggtgttcggatcctggaacctacaccgcgccaccctcggtcagccgctggactggttctgcttgttctcctcgggagcggcattgctcggctcgccgggtcagggcgcctacgcggcggccaacagctgggtcgacgtcttcgcgcactggcgccgcgcccagggcctgccggtcagcgcgattgcgtggggtgcgtggggcgaggtcggccgcgccacgttcttggccgaggggggcgaaatcatgatcaccccggaggaaggtgcgtatgccttcgagacgctcgtgcgccacgaccgcgcctacagcggttacattccgatcctcggggcgccatggctggccgaccttgtccgacgcagcccgtggggtgaaatgttcgcatccactgggcagcggtcaaggggcccaagcaaattccgcatggagctcctttcgctgccgcaagatgaatgggccggccggctacggcgtctgctggttgagcaggccagtgtgatcctgcgtcgcacgatcgacgctgaccgctcattcatcgagtacggcctggattcgctgggcatgctcgagatgcgtacccacgttgaaaccgagaccgggatacgcctgacccccaaggtcatcgccacaaacaacaccgcccgcgctttggcccagtacttggcggacacgctggccgaggagcaggcggcggcaccggcggcatcatag

SEQ ID NO: 575 - DNA, 585 bp, Mycobacterium Tuberculosis
atgaacctggcgacgtgggcggagcgcaacggtgttgctccggggaccgcctaccgctggtttcgtgctggtctgttgtcggtgatggcgaggcgagtgggccgactgattctcgtcgacgaaccggctggggacgctggcatgcgatcaccgaccgcggtgtatgcacgggtgtcgtcggccgatcagaaagccgatctggatcggcaggtcgcgcgggtgaccgcgtgggccacggcccaacagatgccagtcgacaaggtcgtgaccgaggtcggttccgcgttcaacgagcaccgccgtaagttcctttcactgctgcgcgacccgtcagtccaccggatcgtggtggagcaccgggatcggttctgccggttgggctcgaagtacgtgcaggcagcgtttgcggcgcagggccgcgaactggtggtagtcgactctgccgaggtcgatgacgacctggtgcgggatatgaccgagatcctgacgtcgatgtgcgcccgtctgtatggcaaacgggctgccgagaatcgaaccaagcgcgcattggcggccgctgctggcgaggaccatgaggccgcctga

SEQ ID NO: 576 - DNA, 279 bp, Mycobacterium Tuberculosis
gtgtcggtactgacagtccccagacagacccccagacaaagattgccggttttgccgtgccacgtcggtgatcccgatctgtggttcgccgataccccggccggtctcgaggtagccaagacactgtgtgtgagctgcccgatcaggcggcagtgcttggccgcggcgcttcagcgggctgaaccctggggcgtttggggtggtgagatattcgaccaaggctcgatcgtgagtcacaagcgtccgcgcggacgtccgcgcaaggatgctgttgcatag

SEQ ID NO: 577 - DNA, 792 bp, Mycobacterium Tuberculosis
atgagcgtcgagccggacgtcgaaactttggatccgcccctaccgccggtaccggacggcgcggtgatggtgaccgtcaagatcgcccggttcaaccccgacgaccccgacgcgttcgcggccaccggcggctggcagagcttccgggtgccctgtttgcccagcgatcggctgctcaacctgctcatctacatcaagggctacctcgacggcacgctcaccttccggcgatcctgcgcccatggggtgtgcggctctgatgccatgcgcatcaacggggtgaaccggctggcctgcaaggtgctgatgcgtgacctgctgccgaagaagaagggcaaatcgttgaccgtcacggtcgagccgatccgcgggctgccggtggaaaaggacctggtggtcgacatggagccgttcttcgacgcctaccgggcgatcaaaccgtacctgatcaccagcggcaacccgcccacccgcgaacggatccagagcccgaccgaccgcgcccgctacgacgacaccaccaagtgcatcctgtgcgcgtgctgcaccaccagctgcccggtgttctggcacgagggcagctacttcggcccggcggcgatcgtcaacgcgcaccgcttcatcttcgacagccgcgacgaggccgccgccgagcgcctcgacatcctcaacgaggtcgacggggtgtggcgctgccgcaccacgttcaactgcaccgaatcctgcccacggggcattgaggtgaccaaggcgatccaggaggtcaagcgcgcgctgatgttcacccgctga

SEQ ID NO: 578 - DNA, 987 bp, Mycobacterium Tuberculosis
aaagaccgcgtcggctttcttcgcggccgagctcgaccggccagcacgctaattacccggttcatcgccgatcatcagggccaccgcgagggccccgatggtttgcggtggggtgtcgagtcgatctgcacacagctgaccgagctgggtgtgccgatcgccccatcgacctactacgaccacatcaaccgggagcccagccgccgcgagctgcgcgatggcgaactcaaggagcacatcagccgcgtccacgccgccaactacggtgtttacggtgcccgcaaagtgtggctaaccctgaaccgtgagggcatcgaggtggccagatgcaccgtcgaacggctgatgaccaaactcggcctgtccgggaccacccgcggcaaagcccgcaggaccacgatcgctgatccggccacagcccgtcccgccgatctcgtccagcgccgcttcggaccaccagcacctaaccggctgtgggtagcagacctcacctatgtgtcgacctgggcagggttcgcctacgtggcctttgtcaccgacgcctacgctcgcaggatcctgggctggcgggtcgcttccacgatggccacctccatggtcctcgacgcgatcgagcaagccatctggacccgccaacaagaaggcgtactcgacctgaaagacgttatccaccatacggataggggatctcagtacacatcgatccggttcagcgagcggctcgccgaggcaggcatccaaccgtcggtcggagcggtcggaagctcctatgacaatgcactagccgagacgatcaacggcctatacaagaccgagctgatcaaacccggcaagccctggcggtccatcgaggatgtcgagttggccaccgcgcgctgggtcgactggttcaaccatcgccgcctctaccagtactgcggcgacgtcccgccggtcgaactcgaggctgcctactacgctcaacgccagagaccagccgccggctga

SEQ ID NO: 579 - DNA, 435 bp, Mycobacterium Tuberculosis
atgtgggcaggctaccgttgggccatgagcgtcgaactgacacaagaggtttctgccaggctcacgtccgacctttacgggtggttgaccaccgtcgcccgatcggggcagccggttccgcggctggtgtggttctacttcgacgggaccgacctgacggtgtactccatgcctcaggcggccaaggtcgcccacatcaccgcccatccgcaggtcagcctgaacctggactccgacggcaacggcgccgggatcatcgtggtgggcgggacggcggcggtggtggccaccgatgtcgactgccgcgacgacgcgccgtattgggccaagtaccgcgaggatgccgcgaagttcgggctgaccgaggcgatcgccgcctacagcacccggctgaagatcaccccgacccgggtgtggacgacgcccacgggctga

SEQ ID NO: 580 - DNA, 297 bp, Mycobacterium Tuberculosis
gtgtctttcactgcgcaaccggagatgttggcggccgcggctggcgaacttcgttccctgggggcaacgctgaaggctagcaatgccgccgcagccgtgccgacgactggggtggtgcccccggctgccgacgaggtgtcgctgctgcttgccacacaattccgtacgcatgcggcgacgtatcagacggccagcgccaaggccgcggtgatccatgagcagtttgtgaccacgctggccaccagcgctagttcatatgcggacaccgaggccgccaacgctgtggtcaccggctag

SEQ ID NO: 581 - DNA, 1155 bp, Mycobacterium Tuberculosis
atgaaccgaatctggttgcgcgccatcatattgacggccagcagcgcgctgcttgccggctgtcagtttggcgggctgaactcgctgccgctgcctggcaccgccgggcacggtgaaggtgcctactcggtcaccgtcgaaatggctgatgtggcgacgttgccgcagaactcaccggtcatggtcgatgacgtcaccgtcggcagcgtggccggcattgtcgcggtccaacgacccgacggatccttttatgccgccgtgaagctggacctggacaagaatgtgttgctgccggccaacgccgtggcgaaggtctcccagacctcgctgctgggttcgttacatgtagagctggcgccaccgacggaccgcccgccgaccgggaggttggttgacggctcgagaatcaccgaggccaacaccgaccgattccccaccaccgaggaggttttctcggcgctgggggtggtggtcaacaagggtaacgtcggtgcgttggaagagatcattgacgagacccaccaggcggtggcgggtcggcaggcccagttcgtcaacctggtccccaggctcgcggagttgacggcgggcctgaaccggcaggttcacgacatcatcgatgcgttggatgggctgaaccgagtctccgcgatcctggcacgtgacaaggacaacctgggccgagcactggacacgctgcccgacgcggttcgcgtgctcaaccagaaccgggaccacatcgtcgacgcgttcgccgcgctcaaaaggttgacgatggtcacgtcgcacgtgctggccgagaccaaggtggatttcggtgaagacctcaaagacctctactcgatcgtcaaggccctcaacgacgaccgaaaggatttcgtcacctcgctgcagctgttgctgacgttcccatttcccaacttcggtatcaagcaggcggtgcgcggcgactatcttaacgtgttcaccaccttcgacctcaccctgcgccggattggtgagacgttcttcaccacggcgtacttcgacccgaacatggcgcacatggacgagatcctcaacccgcccgacttcctgattggcgaactggccaacctgtccgggcaagcggccgacccatttaagattccacccggtacggcgtcgggacagtag

SEQ ID NO: 582 - DNA, 948 bp, Mycobacterium Tuberculosis
atgaggatgctgcgacgcctacgtcgcgcaactgtcgctgcggctgtgtggctcgcgacggtgtgcctggttgcgtcctgcgccaatgctgatccgctcgggtcagcgaccggcagtgtgaagtccatcgtcgtcgggtccggtgattttccggaatcgcaggtgatcgccgaaatctacgcacaagtgttgcaggccaacggtttcgacgtggggcggcggttgggaattggcagtcgagagacgtatatcctggcgctcaaagatcattccatcgacctggtgccggagtatatcggcaacttgctgctgtactttcaacccgacgccacggtgaccatgctcgatgccgttgagttggagctctacaagcgacttcccggcgatctgtcgatcctgacgccgtcgccggcctctgacactgacaccgtcaccgtcaccgccgctaccgccgcccggtggaacctgaaaacgatcgccgacctggccccgcattccgcggatgtgaagttcgcggcgccgtcggcctttcagacccggccgtccgggttgcccgggctgcggcacaaatactcactcgacatcgcgccgggcaacttcgtgaccatcaacgacggcggcggtgcggtgaccgtgcgagcactggtggagggaacggccacagccgccaacctcttcagcacctctgcggctatcccgcaaaaccacctggtggtgctggaagatcccgaacataacttcctagccggaaacattgtgccgcttgtgaattcgcgaaagaagtcggatcacctcaaagatgtgctggacgcggtgtcggcaaagctgaccactgccggcctggccgagctcaatgcagcggtgtccggcaactccggggtggaccccgaccaggccgcgcggaaatgggtgcgggacaacggtttcgatcatccagtgcggcagtag

SEQ ID NO: 583 - DNA, 1881 bp, Mycobacterium Tuberculosis
gtgccgatggaacacaaacctcccactgccgtcatccaggcggcacacggtgaacactcgttaccgttgcatgacacaacggatttcgacgacgccgatcgcggattcattgccgcgctgtccccgtgtgtgatcaaggctgccgatggtcgcgtggtgtgggacaacgacgcgtactcgtttctcgacggtgccgcgccgacatcggtgcatcccagcctgtggcggcaatcccagctgaccgcgaaacagggcctctaccaggtggtgccgggcatctatcaggtccgcggattcgatatctccaatatcagcttcgttgagggtgacactgggctgatcgtcatcgacccgttggtgtccaccgaggtggccgccgccgcgctggacttgtatcgcgcccaccgcggagccgaccgccccgtggtcgcggtcatctacacccacagccatgtcgatcatttcggtggggtgctcggcgtcaccacccaggccgacgtggacgcgggaaaggtggcggtgctggcgccggaggggttcaccgcgcacgccgtgcaggaaaacatctacgccggctcggcgatgatgcgccgtgcgggctacatgtacggcaccgtgttggcgcgcggtctccgggggcacgtcggctgcggcctcgggcagacactgtcgaccggtgaggtttcgctcgtcgtgccgacggtcgacatcaccgagaccggggagacccacaccatcgacggggtggagatcgagttccagatggccccgggcaccgaggcccctgcggagatgcacttctatttcccgcgcttccgcgcgttgtgcatggccgaaaacgccacgcataacctgcacaacctgctgaccctgcgcggcgccttggtgcgcgatccgcgcgcctggtcgggctatctcaccgaggcgattgacacctttgccgaccgaaccgacgtggtgttcgcctcgcaccactggccgacgtggggacgcgagaagatcgtcgagttcttgtcgcaacagcgcgacatgtattcatatctgcacgatcagacgctgcggctgctgaaccagggctacaccggtgtggagatcgccgagatgttccagctgccaccggcgctgcagcgggcatggcacacccacggctactacgggtcggtcagccataacgtgaaggcgatctatcagcgttacatgggctggtttgacggtaacccgggctggttgtggccgcatccgcccgaggcgctggcgccgcgttatgtcgacgcgttgggtggcatcgaccgagtgctggagctggcccgcgaagccttcgacgcaggtgatttccgttgggcggcaacgcttctcgaccatgcggtgttcgccgacagcgagcacgctgcggcccgcgggctctatgccgacaccctggagcagctggcctacggcgcggagtgtgcgacctggcgcaatttctttctgaccggggccgccgagctgcgcgacgggaacccgggcagctccgggcaagtcccggcgcccacgtttttcgcccagctgacgccggaccaaatctttgacgtcctggcgatcagcatcaatggcccacgcgcatgggacctcgacctggccatcgatttcaccttcaccgagccggatgtcaactatcggctcacgctgcgcaacggcgtgttgatacatcgcaagcttcccgccgatccggcgacggcgaacgcgacggtgacggtgggcgacaaggttcggttggtcgccgcggcgctgggcgatatcagctcacccggtttcgaggtgttcggcgaccggacggtgctgcagacattcttgagcgtcctcgaccggcccgattcggccttcaacatcgtgacgccgtag

SEQ ID NO: 584 - DNA, 1248 bp, Mycobacterium Tuberculosis
atgcgcgctggcgacggcaagatccgtgtcccggccgacctagacgccgtcacggcaaccggcgaagaggaccactccgaaatcgacggtgcggccgtcgaccggatctggcgggccgcacgccattggtatcgggccggtatgcatcccgcgatccagttgtgcattcggcaccatgggcgggtcgtgctcaaccgcgcgatcgggcacggctggggcaacgcccccaccgatgaggccgatgccgagaagatcccggtgacgactgacaccccgttctgcgtgtactcggcggccaaggcgatcacggcgaccgttgtacacatgctcgtcgagcgcggacacttcgcgctcgacgaccgcgtctgcgagtacctgccctcctacaccagtcatggcaagcaccgcaccacgatccggcacgtgctgacccacagcgcaggcgtcccgtttcccaccgggccccgacccgacgtcagacgcgcggacgaccatgaatacgcggtggaaaggctcggcgaactacggccgctatatcggcccggactggtacacatctaccacgcgctgacctggggtccgttgatgcgtgagatcgtctacgcggccaccggcaaggaaatccgcgagatcctggccaccgagatcctcgacccgctgggctttcggtggaccaacttcggcgtcgccgagcgcgatgtgccgctggtcgcgcccagtcacgccaccgggcggcagctgccgccggtgatcgccgcggtgttccgcaaggcgatcggcggaaccgtgcacgagatcatcccctatacgaacaccccgttcttcctcagcaccatcctcccgtcgtccaacactgtgtcaacggccaacgagctgtcccgctttatggaaatcctgcgccgcggtggcgaactcgacggtgttcgtgtactgagtcccgagacgctgcgcggcgcggtgacggaatgccggcgcttgcgaccggacttcgccaccgggctgatgccgcttcgctggggcaccgggttcatgctggggtccgccaagtacgggccgttcgggcgcaacgcgccggcggcattcggccatctcggtctggtcaacattgcggtttgggccgaccccgaacgagctctgtcgggcggtttgatcagtagcggcaaacccggtagggaccccgaggctgggcgctacggcgccctgctgaacgccattaccgccgaaataccacgggcatcgtcgggctga

SEQ ID NO: 585 - DNA, 486 bp, Mycobacterium Tuberculosis
gtgagcgagaaagtcgagtcaaaggggctagcggatgcggcacgcgatcacctcgcggctgagttggcccggctgcggcagcgacgcgatcggctggaggtcgaggtcaagaacgaccggggcatgatcggcgatcacggcgacgcggccgaggcgatacaacgtgccgacgaactggccatcctcggtgaccggatcaatgaactggaccggcggctgcgcaccgggcccaccccctggagcgggtcggaaacgctgcccggcggcaccgaggtgaccttgcggttccctgacggtgaagtcgtcacgatgcatgtaatctccgtcgtcgaagagacgccggtgggccgagaagccgaaaccctgacggcgcgcagcccactaggtcaggccctggccggtcaccaacccggcgacacggtgacctactcgaccccgcagggtcctaatcaggtccagctgcttgctgtcaagctgccctcataa

SEQ ID NO: 586 - DNA, 6381 bp, Mycobacterium Tuberculosis
ttgggcttggggtcggcggcgtcaggcactggtgcagataggggtgcatggacgttggctgaaccacgtgtgactccggttgctgttatcggcatggcttgccggctgcccggcgggatcgattcccccgagttgttgtggaaggcgttgttacgaggcgacgacctgatcaccgaggtgccgccggaccggtgggattgcgacgagttctacgacccgcagccgggcgtgcccggtcggacggtgtgcaagtggggcggtttcctggataaccccgcggatttcgattgcgagttctttggcatcggcgagcgggaggcgattgcgatcgatccgcagcaacgtctgttgctggagacgtcctgggaggccatggagcacgccggtcttactcagcaaacgctggcaggctcggcgaccggcgtgttcgcgggtgtcacccatggtgactacacgatggtggcggccgacgccaaacaattggaggagccgtacggatatctgggcaacagcttcagcatggcgtcgggccgggtcgcctacgcgatgcgactgcacggtccggcaataaccgttgataccgcatgctcgtccggcctgacggccgtgcacatggcgtgtcgcagcctgcacgagggtgaaagcgacgttgccttggcggggggtgtcgccttgatgctggagccacgcaaggccgctgctggatccgctttgggcatgttgtccccgaccggacgttgtcgcgcgttcgatgtcgcggctgacgggttcgtgtcaggcgagggttgtgccgtggtggtgctcaagcggttgccggatgcattggccgacggtgaccggatcctggcggtaattcgtggcacgtccgcaaatcaggatggccacacggtcaatatcgcgacgccttcgcagcccgcacaggttgcggcttatcgagcggcgttggctgccggtggcgtggacgccgcgacggtcggcatggtcgaagcgcacggccccggcaccccgatcggtgaccccattgaatatgcaagtgtctccgaggtgtatggggtcgacggcccgtgcgcactcgcatcggtgaagaccaacttcggacacacccagtcgaccgccggggtgctagggctaatcaaggtggttctcgctctgaaacatggtgtggttccacgtaatctgcacttcactcggctgcccgatgagattgctggcatcaccaccaacctcttcgtgcccgaggtgaccacaccgtggcccaccaacggtcgtcaggtgccccggcgggcggcagtgtcgtcttatgggttctcgggaacgaacgtgcacgctgttgtggagcaagctccgcaaaccgaagcccagccccacgcggcgagcacccccccgaccggcacccctgccttgttcacgctgtccgcttcctcggccgacgcgctgcggcagactgctcagcggttgaccgactggatacagcagcacgccgactccctggtgctctcggatcttgcgtacacgctggcgcggcggcgtacgcaccggtcggtgcgcacggcggtcatcgcgagcagcgtcgacgagctgattgccggcttgggcgaggtcgccgacggtgacaccgtttaccagcccgcggtggggcaggatgaccgcgggccggtctggttattctccgggcaagggtcgcagtgggcagcgatgggcgccgatctgctgacgaacgaatcggtgttcgccgcgaccgttgcggagctagagccattgatcgccgcggagtccgggttctcggtcaccgaggcgatgacggcgcccgagaccgtgactggcatcgacagagttcagccgaccatcttcgcgatgcaggtcgcgttggcagccacgatggcggcatacggagtgcgcccgggcgccgtgatcggccactcaatgggtgagtcggccgcggctgtggtcgcaggagtgctgtcagccgaagatggggtacgcgtcatctgccgacgatcaaaactgatggcgacgatcgccggttccgcggcgatggcgtcggtggagttgcctgccttagctgtgcagtcggaattgaccgctctaggcatcgacgatgtggtggtcgccgtggtgaccgcgccgcagtccaccgtgatcgccggaggcaccgagtcggtgcgcaagctggtcgacatatgggagcggcgagacgtgctggcgcgggcggtggccgtcgacgtggcttcgcattcgccgcaggtggatccgatcctcgacgagttgatagctgcgctggccgacctgaatccgaaagctcctgagattccctactattcggcgacgcttttcgacccgcgcgaagcgccggcgtgcgacgcgcgttactgggccgacaatttgcgccacaccgtgcggttctccgctgcggtgcgctcggcgctcgacgacgggtaccgagtcttcgccgagctttcgccgcacccgctgctgacccacgcggtcgatcagattgccggcagtgtaggcatgccggttgccgcgctggccggtatgcggcgggagcagccattgccgctggggctccgtcgcctgctgacggatctgcacaacgctggtgcggcagtggacttctcggtgctctgtccccaaggccgcttggtcgatgctccgctgccggcgtggtcgcaccggttcctgttctatgaccgcgaaggcgttgacaatcggtcgccgggtggctccacggtagccgtgcacccgttgttgggcgcacacgtgcgattgcccgaagagccggaacgccacgcctggcaggccgatgttggtaccgcaaccttgccctggttgggcgatcaccggatacacaacgtggctgctcttccaggggccgcctactgcgagatggcgttgtctgcggcccgtgccgtcctcggcgagcagtccgaagtacgcgacatgcgctttgaggcgatgctgctgctggatgaccagaccccggtgtccaccgtggcaacggtgacctcgcccggtgtcgtcgacttcgccgtcgaggccttgcaggaaggcgttgggcatcacttgcggcgtgcgtcggcggtgctgcagcaggtatccggcgaatgcgagccgccggcgtacgacatggcctccttattggaagcccacccttgccgcgtggacggtgaggatctgcgccggcaattcgacaagcacggtgtgcaatatggtccggccttcaccggcctggccgtggcctatgtcgcggaggatgcgaccgccacaatgctggccgaagtcgcgctgcccggctcgattcgttcgcagcagggcctgtacgcaatccacccggccctcctggatgcctgtttccagtcggtcggcgcgcatcccgatagccagtcggtaggtagcggcctattggtgccgttgggggtgcgccgagtccgtgcctatgctccggtgcgtaccgctcgctattgctacacgcgggtgaccaaagtcgagttggtcggcgtcgaggccgatatcgacgtgctggacgcgcacggcacggtgttgctggccgtgtgcggactgcgaatcggtacgggagtgtccgagcgcgacaaacacaatcgggtgctgaatgagcgcttactcaccatcgaatggcaccagcgtgagctgcccgagatggacccctctggcgctggaaaatggctgctgatcagtgactgcgctgcctctgatgtgaccgctacccggctagcggacgcgtttagggaacacagcgcggcgtgcacgacgatgcggtggccactgcacgacgaccagttggccgccgccgaccagctacgcgatcaagttggtagcgacgagtttagcggcgtggtcgtgctcaccgggtcgaacaccggtacgccgcatcaggggagcgcggatcgcggcgctgagtacgttcgccggctggtgggtatcgctcgcgaattgtcagaccttcccggggcggtgccgcgcatgtacgtcgtgacgcggggtgcccagcgggtgctggccgacgactgcgtcaatcttgagcagggcgggctgcgtggtctactgcggacgatcggcgccgagcaccctcacctgcgtgccacccagatcgacgtggacgaacagaccggtgtcgagcagctggcacgccaattgctggccacgtcggaagaagacgagaccgcctggcgagacaacgagtggtacgtggcgcgcttgtgtccgaccccgttgcgtcctcaggagcggcgcaccatcgtcgcggatcatcagcagagcggcatgcgcctgcagatccgtacccccggcgatatgcaaacgatagagctggccgcgtttcaccgcgttccaccaggaccaggacagatcgaggttgcggtccgtgcgtccagcgtcaactttgccgatgtactcatcgctttcggtcgctaccccagcttcgagggacacctgccccagctgggcacggatttcgccggcgtggtgaccgcggtcggaccaggcgtcactgaccacaaggttggtgaccatgttggtggcatgtcgcctaacggctgctggggcacattcgtcacgtgtgacgctcggctggccgcgacgctgccaccgggcctgggtgacgcacaggccgctgcggtgaccaccgcgcacgccaccgcctggtacggactgcatgagctcgcccggattagggcgggtgacacggtgctaattcactccggcaccggcggggtcggacaagcggcgatcgctatagcccgcgcggcgggcgctgagatcttcgccaccgccggtaccccacagcgtcgagagctattgcgcaacatgggtattgagcatgtctatgactcgcgcagcatcgagttcgccgagcagattcggcgggacactaacggccggggtgtcgatgtcgtgctcaactcggtgaccggcgccgcgcaacttgccgggctgaaactgctcgccttccggggacggttcgtcgagattggcaagcgcgacatctatggtgacaccaagctggggctctttcccttccggcgcaacctgtccttctacgccgtagacctggggttgctgtctgcgacacacccagaagagctgcgcgacctgctcggcacggtctatcgcttgaccgcagccggcgagttgccgatgccgcagagcacccattaccccctcgtcgaggcggccaccgccatccgtgtgatgggcaacgccgagcacaccggcaaactcgtcctccacatcccacagaccggaaaaagcctcgttaccctgcctccggaacaagctcaggtgttccgtcccgacggctcctacatcatcaccggcggcctcggtgggctagggctgttcctggccgagaagatggccgcggccggttgcggccggatcgtgctgaattcccgcacccagccgacgcaaaagatgagggaaacgatcgaggccatcgcggcgatgggctctgaagtcgtggtggaatgcggtgacatcgcccaaccgggtaccgcggagcggttggtggcgaccgctgtggccaccgggcttccggtacgaggcgtgctacacgcggccgcggtggtcgaggacgccaccttggccaatatcaccgacgagttgctggcgcgcgactgggcgccaaaggttcacggtgcctgggagttgcatgaagcaaccagcggacagccgcttgactggttctgcttgttttcgtcggcggcagctctcaccggctcgccgggacagagtgcctactcagcggccaacagctggctggacgccttcgcgcattggcggcaagctcagggcctgccggctaccgcgatcgcgtggggagcctggtcggatatcggccagttggggtggtggtcggcatcgcccgcgcgggcttcggcattggaggaaagcaactacacggcgatcactcccgacgaaggtgcttacgcgttcgaggcgctattgcgccacaaccgcgtctataccggctatgccccggtcatcggagccccgtggctggtcgccttcgcagagcgcagccggtttttcgaagtgttctccagcagcaacggttcgggcacaagcaaattccgcgtcgagctgaacgagctgccacgcgacgagtggccggcgcggcttcggcagctggtcgccgagcaggtcagcctgattctgcggcgcaccgtcgaccctgaccgcccgctacccgagtatggacttgattcgttgggcgcactagagctgcgcactcggatcgagaccgagaccggaatccggttggcacccaagaacgtcagcgccacggtgcggggcttagcggatcacttgtatgaacagctggcgcccgacgacgctcctgctgccgcgctgtcgtcacagtaa

What is claimed is:

1. A method for the detecting presence of antibodies which specifically bind to antigens of *M. tuberculosis* and which are present in a bodily fluid sample, comprising contacting the sample with antigens of *M. tuberculosis*, wherein at least two of the antigens are encoded by nucleic acids Rv3874 (SEQ ID NO:547) and Rv0798c (SEQ ID NO:121), respectively, and detecting antibodies which bind to the antigens.

2. The method of claim 1, wherein the antigens are present in a crude expression extract or in partially purified form.

3. The method of claim 1, wherein the step of detecting the antibodies comprises use of a signal-generating anti-antibody.

4. The method of claim 1, wherein binding affinity of respective antibodies which specifically bind to antigens of *M. tuberculosis* are known and indicative of an activity state of tuberculosis.

5. The method of claim 1 wherein the antigens of *M. tuberculosis* are coupled to a solid phase prior to the step of contacting the sample with the antigens.

6. The method of claim 5 wherein the antigens of *M. tuberculosis* are coupled to the solid phase in an array.

7. The method of claim 1 further comprising a step of selecting the at least two of the antigens such that an average quantity of antibodies produced in a patient against the at least two antigens is in an upper quartile of quantity of antibodies produced in the patient.

8. The method of claim 1 further comprising a step of selecting the at least two of the antigens on the basis of quantified and known relative reactivities with respect to sera of a population infected with *M. tuberculosis.*

9. The method of claim 8 wherein the known reactivities are characterized by activity state of the disease.

10. The method of claim 8 wherein the known reactivities are characterized by strength of immunogenicity.

11. The method of claim 8 wherein the at least two of the antigens are immunodominant antigens.

12. The method of claim 1 wherein the at least two of the antigens are known as being associated with active disease after infection.

13. The method of claim 1, wherein the at least two of the antigens are encoded by nucleic acids Rv0798c (SEQ ID NO:121) and Rv3874 (SEQ ID NO:547), and wherein the antigens further comprise at least one antigen of *M. tuberculosis* that is encoded by a sequence selected from the group consisting of Rv3616c (SEQ ID NO:509) and Rv0456c (SEQ ID NO:74) or antibody binding fragments thereof.

* * * * *